US011608501B2

(12) United States Patent
Bhattacharyya et al.

(10) Patent No.: US 11,608,501 B2
(45) Date of Patent: Mar. 21, 2023

(54) METHODS FOR MODIFYING RNA SPLICING

(71) Applicant: PTC THERAPEUTICS, INC., South Plainfield, NJ (US)

(72) Inventors: Anuradha Bhattacharyya, Edison, NJ (US); Amal Dakka, Whitehouse Station, NJ (US); Kerstin Effenberger, Metuchen, NJ (US); Vijayalakshmi Gabbeta, Bridgewater, NJ (US); Minakshi B. Jani, Iselin, NJ (US); Wencheng Li, Martinsville, NJ (US); Nikolai Naryshkin, East Brunswick, NJ (US); Christopher Trotta, Somerset, NJ (US); Kari Wiedinger, New Providence, NJ (US)

(73) Assignee: PTC Therapeutics, Inc., South Plainfield, NJ (US)

( * ) Notice: Subject to any disclaimer, the term of this patent is extended or adjusted under 35 U.S.C. 154(b) by 551 days.

(21) Appl. No.: 16/622,223

(22) PCT Filed: Jun. 13, 2018

(86) PCT No.: PCT/US2018/037412
§ 371 (c)(1),
(2) Date: Dec. 12, 2019

(87) PCT Pub. No.: WO2018/232039
PCT Pub. Date: Dec. 20, 2018

(65) Prior Publication Data
US 2020/0370043 A1 Nov. 26, 2020

Related U.S. Application Data

(60) Provisional application No. 62/519,226, filed on Jun. 14, 2017.

(51) Int. Cl.
| | | |
|---|---|---|
| *C12N 15/11* | (2006.01) | |
| *C07D 401/02* | (2006.01) | |
| *C07D 401/14* | (2006.01) | |
| *C07D 417/02* | (2006.01) | |
| *C07D 417/14* | (2006.01) | |

(52) U.S. Cl.
CPC .......... *C12N 15/111* (2013.01); *C07D 401/02* (2013.01); *C07D 401/14* (2013.01); *C07D 417/02* (2013.01); *C07D 417/14* (2013.01); *C12N 2320/30* (2013.01)

(58) Field of Classification Search
None
See application file for complete search history.

(56) References Cited

U.S. PATENT DOCUMENTS

| | | |
|---|---|---|
| 3,558,618 A | 1/1971 | Trepanier et al. |
| 4,122,274 A | 10/1978 | Juby |
| 4,342,870 A | 8/1982 | Kennis et al. |
| 5,089,633 A | 2/1992 | Powers et al. |
| 5,599,816 A | 2/1997 | Chu et al. |
| 6,630,488 B1 | 10/2003 | Lamothe et al. |
| 6,977,255 B2 | 12/2005 | Robertson et al. |
| 7,326,711 B2 | 2/2008 | Wang et al. |
| 7,399,767 B2 | 7/2008 | Zhang et al. |
| 7,563,601 B1 | 7/2009 | Gaur et al. |
| 7,569,337 B2 | 8/2009 | Auberson |
| 7,897,792 B2 | 3/2011 | Iikura et al. |
| 8,337,941 B2 | 12/2012 | Gubernator et al. |
| 8,633,019 B2 | 1/2014 | Paushkin et al. |
| 8,962,842 B2 | 2/2015 | Roussel et al. |
| 9,371,336 B2 | 6/2016 | Lee et al. |
| 9,399,649 B2 | 6/2016 | Chen et al. |
| 9,586,955 B2 | 3/2017 | Qi et al. |
| 9,617,268 B2 | 4/2017 | Woll et al. |
| 9,879,007 B2 | 1/2018 | Qi et al. |
| 9,969,754 B2 | 5/2018 | Ratai et al. |

(Continued)

FOREIGN PATENT DOCUMENTS

| | | |
|---|---|---|
| CN | 104349777 A | 2/2015 |
| EP | 1227084 A1 | 7/2002 |

(Continued)

OTHER PUBLICATIONS

Palacino et al. Nature Chemical Biology (2015), vol. 11, pp. 511-517.*

(Continued)

*Primary Examiner* — Patrick T Lewis
(74) *Attorney, Agent, or Firm* — Jones Day

(57) ABSTRACT

Described herein is an intronic recognition element for splicing modifier (iREMS) that can be recognized by a small molecule splicing modifier compound of Formula (I) provided herein or a form thereof, wherein W, X, A and B are as defined herein. In one aspect, methods for modifying RNA splicing to modulate the amount of a product of a gene, wherein a precursor RNA transcript transcribed from the gene that contains an intronic REMS is modified utilizing a splicing modifier compound of Formula (I), are described herein. In another aspect, methods for modifying RNA splicing to modulate the amount of an RNA transcript or protein product encoded by a gene, wherein a precursor RNA transcript transcribed from the gene is modified to comprise an intronic REMS utilizing a splicing modifier compound of Formula (I), are described herein.

17 Claims, 6 Drawing Sheets

Specification includes a Sequence Listing.

(56) References Cited

U.S. PATENT DOCUMENTS

| | | | |
|---|---|---|---|
| 10,195,202 | B2 | 2/2019 | Naryshkin |
| 10,208,067 | B2 | 2/2019 | Gillespie et al. |
| 2002/0110543 | A1 | 8/2002 | Chiocca et al. |
| 2003/0199526 | A1 | 10/2003 | Choquette et al. |
| 2005/0009843 | A1 | 1/2005 | Nakayama et al. |
| 2005/0048549 | A1 | 3/2005 | Cao et al. |
| 2007/0087366 | A1 | 4/2007 | Holt et al. |
| 2008/0255162 | A1 | 10/2008 | Bruendl et al. |
| 2009/0170793 | A1 | 7/2009 | Gaur et al. |
| 2009/0305900 | A1 | 12/2009 | Belouchi et al. |
| 2010/0303776 | A1 | 12/2010 | Samulski et al. |
| 2013/0245035 | A1 | 9/2013 | Roussel et al. |
| 2014/0206661 | A1 | 7/2014 | Axford et al. |
| 2014/0249210 | A1 | 9/2014 | Lutz et al. |
| 2015/0005289 | A1 | 1/2015 | Qi et al. |
| 2015/0119380 | A1 | 4/2015 | Woll et al. |
| 2015/0080383 | A1 | 5/2015 | Yang et al. |
| 2017/0000794 | A1 | 1/2017 | Naryshkin et al. |
| 2017/0001995 | A1 | 1/2017 | Metzger et al. |
| 2018/0161456 | A1 | 6/2018 | Naryshkin et al. |
| 2019/0134045 | A1 | 5/2019 | Naryshkin |

FOREIGN PATENT DOCUMENTS

| | | |
|---|---|---|
| JP | S56150091 A | 11/1981 |
| WO | WO 1993023398 A1 | 11/1993 |
| WO | WO 1996/039407 A1 | 12/1996 |
| WO | WO 1998025930 A2 | 6/1998 |
| WO | WO 1998025930 A3 | 6/1998 |
| WO | WO 2002/087589 A1 | 11/2002 |
| WO | WO 2004009558 A2 | 1/2004 |
| WO | WO 2004009558 A3 | 1/2004 |
| WO | WO 2004/113335 A2 | 12/2004 |
| WO | WO 2004/113335 A3 | 12/2004 |
| WO | WO 2005/105801 A1 | 11/2005 |
| WO | WO 2008077188 A1 | 7/2008 |
| WO | WO 2009151546 A2 | 5/2009 |
| WO | WO 2009151546 A3 | 5/2009 |
| WO | WO 2007109211 A2 | 9/2009 |
| WO | WO 2007109211 A3 | 9/2009 |
| WO | WO 2007109211 A8 | 9/2009 |
| WO | WO 2009156861 A2 | 12/2009 |
| WO | WO 2009156861 A3 | 12/2009 |
| WO | WO 2009156861 A8 | 12/2009 |
| WO | WO 2010000032 A1 | 1/2010 |
| WO | WO 2010019236 A1 | 2/2010 |
| WO | WO 2011050245 A1 | 4/2011 |
| WO | WO 2011062853 A1 | 5/2011 |
| WO | WO 2011085990 A1 | 7/2011 |
| WO | WO 2011085990 A8 | 7/2011 |
| WO | WO 2013059606 A1 | 4/2013 |
| WO | WO 2013101974 A1 | 7/2013 |
| WO | WO 2013112788 A1 | 8/2013 |
| WO | WO 2013119916 A2 | 8/2013 |
| WO | WO 2013119916 A3 | 8/2013 |
| WO | WO 2013130689 A1 | 9/2013 |
| WO | WO 2013142236 A1 | 9/2013 |
| WO | WO 2014012050 A2 | 1/2014 |
| WO | WO 2014012050 A3 | 1/2014 |
| WO | WO 2014028459 A1 | 2/2014 |
| WO | WO 2014116845 A1 | 7/2014 |
| WO | WO 2015017589 A1 | 2/2015 |
| WO | WO 2015024876 A2 | 2/2015 |
| WO | WO 2015024876 A3 | 2/2015 |
| WO | WO 2015095446 A1 | 6/2015 |
| WO | WO 2015095449 A1 | 6/2015 |
| WO | WO 2015105657 A1 | 7/2015 |
| WO | WO 2015173181 A1 | 11/2015 |
| WO | WO 2016042015 A1 | 3/2016 |
| WO | WO 2016/128343 A1 | 8/2016 |
| WO | WO 2016196386 A1 | 12/2016 |
| WO | WO 2018098446 A1 | 5/2018 |
| WO | WO 2018232039 A1 | 12/2018 |
| WO | WO 2019028440 A1 | 2/2019 |
| WO | WO 2019060917 A2 | 3/2019 |
| WO | WO 2019060917 A3 | 3/2019 |

OTHER PUBLICATIONS

Coady et al., 2010, "Trans-splicing-mediated improvement in a severe mouse model of spinal muscular atrophy," J Neurosci., 30(1):126-130.

Falaleeva et al., 2016, "Dual function of C/D box small nucleolar RNAs in rRNA modification and alternative pre-mRNA splicing," Proc Natl Acad Sci USA, 113(12):E1625-1634.

Greene et al., 1991, Protective Groups in Organic Synthesis (1991), Chapter 1, p. 1-16; Wiley, New York.

Hernández-Imaz et al., 2015, "Functional Analysis of Mutations in Exon 9 of NF1 Reveals the Presence of Several Elements Regulating Splicing," Plos One, 10(10):e0141735 (15 pages).

Higuchi et al., 1987, "Pro-drugs as Novel Delivery Systems," vol. 14 of the A.C.S. Symposium Series, and in Bioreversible Carriers in Drug Design, ed. Edward B. Roche, American Pharmaceutical Association and Pergamon Press (6 pages).

Hua et al., 2012, "Peripheral SMN restoration is essential for long-term rescue of a severe SMA mouse model," Nature, 478(7367):123-126.

Jarecki et al., 2005, "Diverse small-molecule modulators of SMN expression found by high throughput compound screening: early leads towards a therapeutic for spinal muscular atrophy," Human Molecular Genetics, 14(14):2003-2018.

Knight et al., 2004, "Isoform-specific phosphoinositide 3-kinase inhibitors from an arylmorpholine scaffold," Bioorganic & Medicinal Chemistry, 12:4749-4759.

Kocar et al., 2002, "Transformations of 3-aminopyridazines. Synthesis of 4-oxo-4H-pyrimido [1,2-b]pyridazine and 1-(substituted pyridazin-3-yi)-1H-1,2,3-triazole derivatives,"ARKIVOC 2002 (viii) 143-156.

Le et al., 2005, "SMND7, the major product of the centromeric survival motor neuron (SMN2) gene, extends survival in mice with spinal muscular atrophy and associates with full-length SMN," Human Molecular Genetics, 14(6):845-857.

Liu et al., 1996, "A novel nuclear structure containing the survival of motor neurons protein," EMBO J., 15(14):3555-3565.

Makhortova, et al. 2011, "A Screen for Regulators of Survival of Motor Neuron Protein Levels," Nat Chern Bioi, 7(8):544-552.

Naryshkin et al., 2014, "SMN2 splicing modifiers improve motor function and longevity in mice with spinal muscular atrophy," Science, 345(6197):688-693 (including supplementary materials).

Palacino, et al., 2015, "SMN2 splice modulators enhance U1-pre-mRNA association and rescue SMA mice," Nature chemical biology, 11(7):511-517 (including corrigendum and supplementary materials).

Passini et al., 2001, "Antisense Oligonucleotides Delivered to the Mouse CNS Ameliorate Symptoms of Severe Spinal Muscular Atrophy," Sci Transl Med., 3(72):72ra18 (21 pages).

Peng et al., 2011, "Identification of pyrido [1, 2-α] pyrimidine-4-ones as new molecules improving the transcriptional functions of estrogen-related receptor α", Journal of medicinal chemistry, 54(21):7729-7733.

Pinard et al., 2017, "Discovery of a Novel Class of Survival Motor Neuron 2 Splicing Modifiers for the Treatment of Spinal Muscular Atrophy." J Med Chem. 60(10):4444-4457.

PubChem compound CID 377422. Mar. 26, 2005. (Retrieved from the Internet Oct. 27 2014: <http://pubchem.ncbi.nlm.nih.gov//compound/377422?from=summary>) (13 pages).

Ratni et al., 2016, "Specific Correction of Alternative Survival Motor Neuron 2 Splicing by Small Molecules: Discovery of a Potential Novel Medicine to Treat Spinal Muscular Atrophy." J Med Chem. 59(13):6086-6100.

Singh et al., 2007, "Modulating role of RNA structure in alternative splicing of a critical exon in the spinal muscular atrophy genes," Nucleic Acids Research, 35(2):371-389.

(56) References Cited

OTHER PUBLICATIONS

Sivaramakrishnan et al., 2017, "Binding to SMN2 pre-mRNA-protein complex elicits specificity for small molecule splicing modifiers," Nature Communications, 8(1476):1-13 (including supplementary material).
Zhao et al., 2016, "Pharmacokinetics, pharmacodynamics, and efficacy of a small-molecule SMN2 splicing modifier in mouse models of spinal muscular atrophy," Hum Mol Genet., 25(10):1885-1899.
European Patent Office, Communication pursuant to Article 94(3) EPC dated Mar. 23, 2018 in Application No. 14877918.4.
Supplementary European Search Report completed Nov. 2, 2018 in European Application No. 16804178 (3 pages).
Restriction Requirement dated Feb. 4, 2019 in U.S. Appl. No. 15/577,584 (9 pages).
Response to Restriction Requirement filed May 6, 2019 in U.S. Appl. No. 15/577,584 (8 pages).
Non-final Rejection and Notice of References Cited dated Jun. 5, 2019 in U.S. Appl. No. 15/577,584 (9 pages).
Response to Non-final Rejection filed Sep. 3, 2019 in U.S. Appl. No. 15/577,584 (11 pages).
Final Rejection dated Sep. 24, 2019 in U.S. Appl. No. 15/577,584 (12 pages).
Written Opinion of the International Searching Authority dated Aug. 30, 2013 in PCT/US2013/025292 (6 pages).
International Preliminary Report on Patentability Chapter I dated Aug. 12, 2014 in PCT/US2013/025292 (7 pages).
International Search Report dated Nov. 15, 2016 in PCT/US2016/034864 (6 pages).
Written Opinion of the International Searching Authority dated Nov. 15, 2016 in PCT/US2016/034864 (9 pages).
International Preliminary Report on Patentability Chapter II completed Jun. 26, 2017 in PCT/US2016/034864 (94 pages).
International Search Report dated Apr. 13, 2018 in PCT/US2017/063323 (7 pages).
Written Opinion of the International Searching Authority dated Apr. 13, 2018 in PCT/US2017/063323 (9 pages).
International Preliminary Report on Patentability Chapter I dated May 28, 2019 in PCT/US2017/063323 (10 pages).
International Search Report dated Sep. 17, 2018 in PCT/US2018/037412 (4 pages).
Written Opinion of the International Searching Authority dated Sep. 17, 2018 in PCT/US2018/037412 (4 pages).
Calder et al., Nov. 2016, "Small Molecules in Development for the Treatment of Spinal Muscular Atrophy." J Med Chem. 59(22):10067-10083.
Cheung et al., Dec. 2018., "Discovery of Small Molecule Splicing Modulators of Survival Motor Neuron-2 (SMN2) for the Treatment of Spinal Muscular Atrophy (SMA)." J Med Chem. 61(24):11021-11036.
International Search Report dated Aug. 30, 2013 in PCT/US2013/025292 (6 pages).
Mercer, et al. 2015, "Genome-wide discovery of human splicing branchpoints." Genome Res. 25(2):290-303.
Notice of Allowance dated Jan. 15, 2020 in U.S. Appl. No. 15/577,584 (5 pages).
Response to Communication pursuant to Rules 70(2) and 70a(2) filed Sep. 3, 2021 in EP Application No. 18817883 (8 pages).
Response to Final Office Action filed Dec. 20, 2019 in U.S. Appl. No. 15/577,584 (7 pages).
Shao et al., 2012, "Synthesis and structure-activity relationship (SAR) study of 4-azabenzoxazole analogues as H3 antagonists," Bioorganic & medicinal chemistry letters 22.5 (2012): 2075-2078.
Supplementary European Search Report dated Feb. 4, 2021 in European Application No. 18817883 (with communication) (9 pages).
Supplementary Partial European Search Report and Provisional Opinion Accompanying the Partial Search Result dated Jun. 25, 2020 in European Patent Application No. 17873550.2 (21 pages).
Yuo et al., 2008, "5-(N-ethyl-N-isopropyl)-amiloride enhances SMN2 exon 7 inclusion and protein expression in spinal muscular atrophy cells," Annals of neurology 63.1 (2008): 26-34.

\* cited by examiner

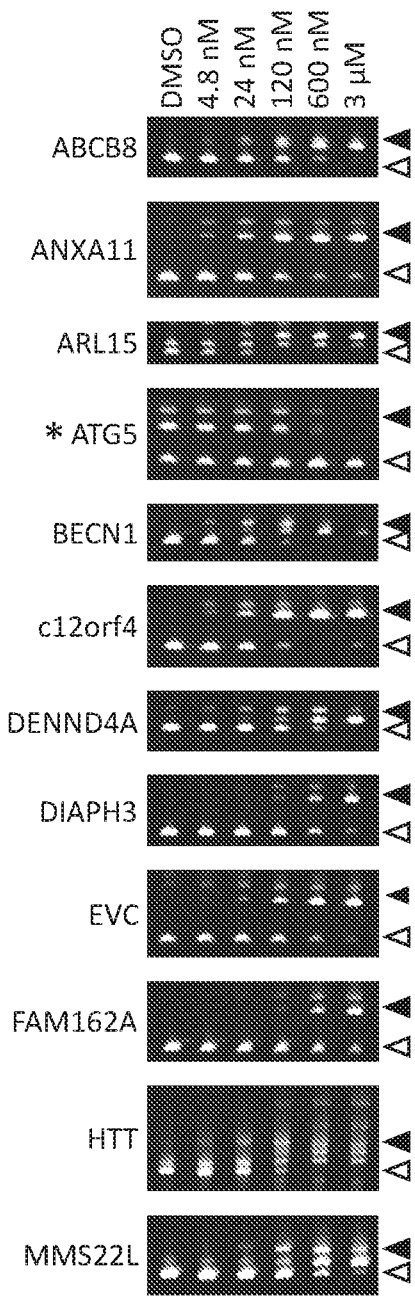
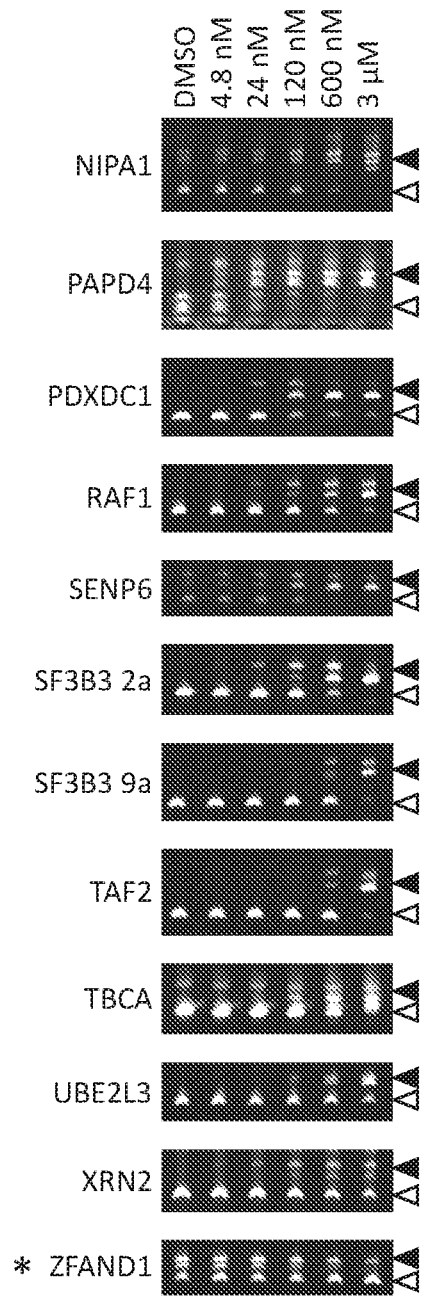
Figure 2A
Figure 2B

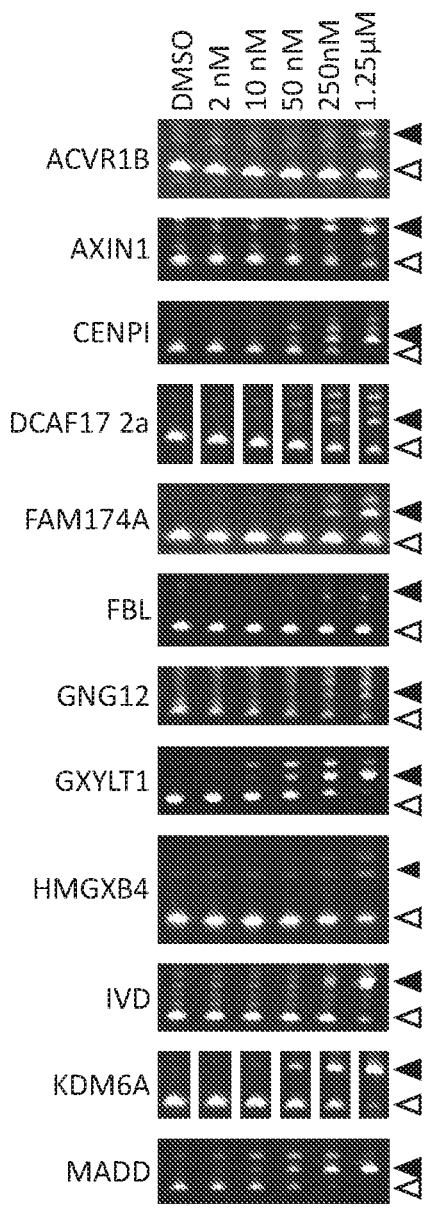
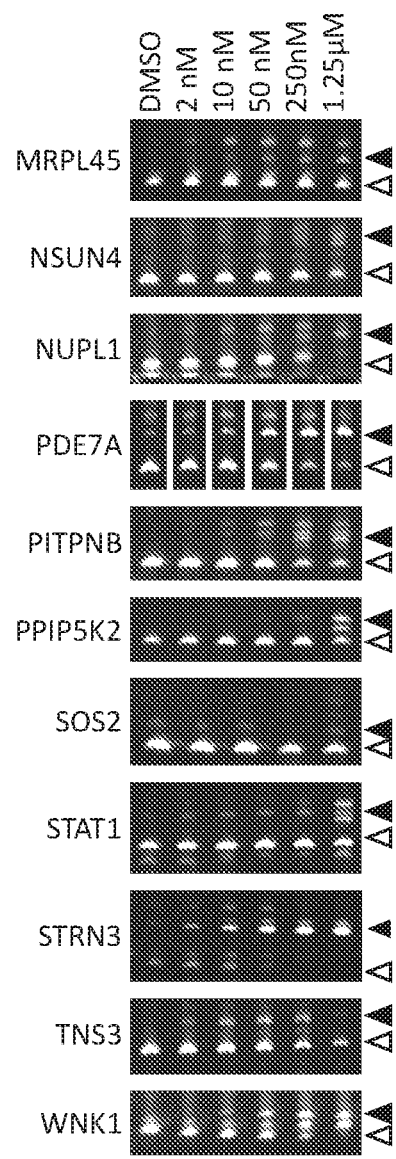
Figure 3A
Figure 3B

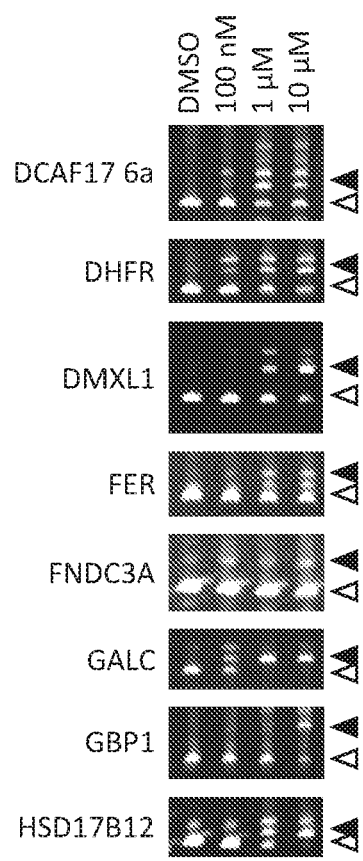
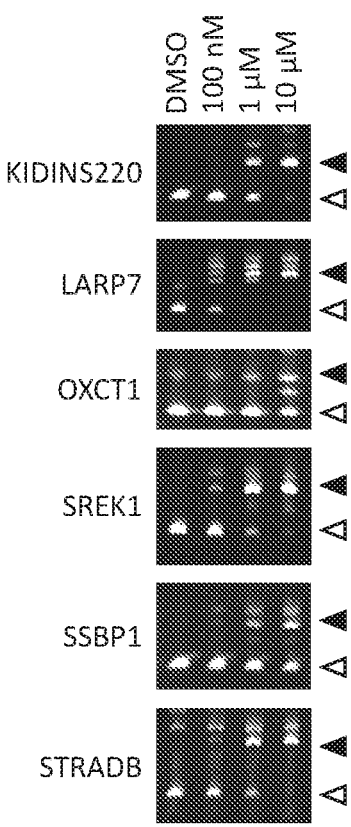
Figure 4A
Figure 4B

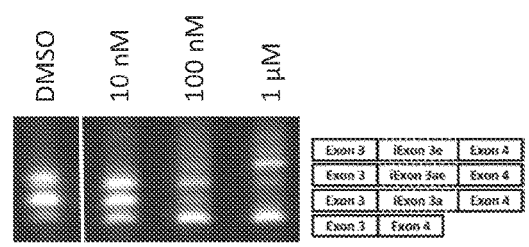
Figure 6A
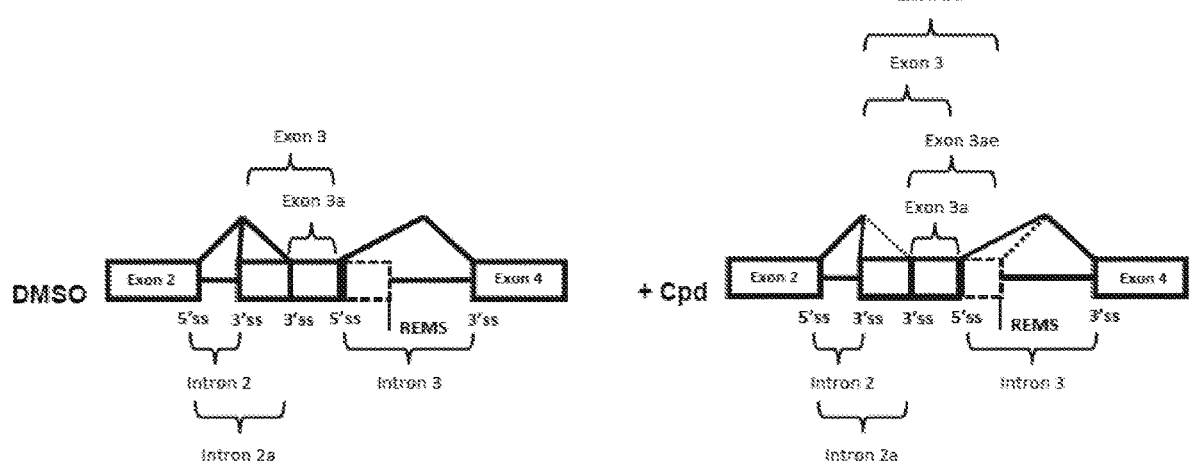
Figure 6B                                    Figure 6C

US 11,608,501 B2

METHODS FOR MODIFYING RNA SPLICING

CROSS REFERENCE TO RELATED APPLICATIONS

This application is a U.S. national stage application of International Patent Application No. PCT/US2018/037412, filed Jun. 13, 2018, which claims the benefit of U.S. provisional application No. 62/519,226, filed on Jun. 14, 2017, each of which is incorporated by reference herein in its entirety.

REFERENCE TO SEQUENCE LISTING SUBMITTED ELECTRONICALLY

This application incorporates by reference a Sequence Listing submitted with this application as a text file in ASCII format entitled "10589-277-228_Sequence_Listing.txt" created on Jun. 13, 2018 and having a size of 1,200,491 bytes.

INTRODUCTION

In one aspect, described herein is a recognition element for splicing modifier (REMS) present in an intron (i.e., an "intronic REMS" or "iREMS") that can be recognized as a 5' splice site by the U1 snRNP and/or other components of the pre-mRNA splicing machinery in the presence of a small molecule splicing modifier, wherein gene expression is modified by inducing alternative splicing of intronic exons (iExons) in the transcribed RNA. In another aspect, described herein are methods for modulating the amount of a product of a gene, wherein a precursor RNA transcript transcribed from the gene contains an intronic REMS, a branch point and a 3' splice site, and the methods utilize a small molecule compound described herein to induce alternative splicing of iExons. More particularly, described herein are methods for modulating the amount of an RNA transcript or protein product encoded by a gene via alternative splicing of iExons, wherein a precursor RNA transcript transcribed from the gene comprises an endogenous or non-endogenous intronic REMS, and the methods utilize a compound described herein to induce iExon alternative splicing. In another aspect, provided herein are artificial gene constructs comprising an intronic REMS (including an endogenous or non-endogenous intronic REMS), and uses of those artificial gene constructs to modulate protein production via iExon alternative splicing in the presence of a small molecule splicing modifier compound. In another aspect, provided herein are methods for altering genes to comprise a non-endogenous intronic REMS, and the use of a small molecule compound described herein to induce alternative splicing of iExons, subsequently modulating the amount and modifying the type of protein produced from such altered non-endogenous gene transcripts.

BACKGROUND

Diseases associated with expression of an aberrant quantity (lower or higher than normally required) of gene product or of an aberrant gene product (e.g., where the production of an aberrant RNA transcript or protein causes a disease) are often treated with a focus on affecting aberrant protein expression. However, targeting components of the splicing process responsible for production of aberrant RNA before the aberrant protein or aberrant quantity of protein is expressed by using a small molecule may affect the underlying cause of a disease or disorder, and thus more efficiently prevent or ameliorate the disease or disorder caused by expression of the aberrant gene product or aberrant quantity of gene product. Accordingly, there is a need for methods of modulating the expression of aberrant RNA transcripts encoded by certain genes using small molecules to prevent or treat diseases associated with expression of aberrant RNA transcripts or associated proteins or associated with expression of an aberrant quantity of RNA transcripts or associated proteins.

SUMMARY

In one aspect, provided herein is a recognition element for splicing modifier (otherwise referred to as "REMS") present in an intron (i.e., an "intronic REMS" or "iREMS") capable of being recognized by the U1 snRNP and/or other components of the pre-mRNA splicing machinery in the presence of a small molecule splicing modifier, whereby elements of the splicing reaction are affected as further described herein. In a specific aspect, the intronic REMS comprises the nucleotide sequence GAgurngn found in an intronic sequence at the RNA level, wherein r is A or G (i.e., a purine nucleotide carrying adenine or guanine) and n is any nucleotide. In another specific aspect, the intronic REMS comprises the nucleotide sequence GAguragu found in an intronic sequence at the RNA level, wherein r is adenine or guanine. In a specific aspect, the intronic REMS comprises the nucleotide sequence NNGAgurngn (SEQ ID NO: 1) found in an intronic sequence at the RNA level, wherein r is A or G (i.e., a purine nucleotide carrying adenine or guanine) and n or N is any nucleotide. In another specific aspect, the intronic REMS comprises the nucleotide sequence NNGAguragu (SEQ ID NO: 2) found in an intronic sequence at the RNA level, wherein r is adenine or guanine and N is any nucleotide. In one or more of such specific aspects provided herein, N is adenine or guanine.

In another aspect, in addition to the iREMS sequence, the intron of an RNA transcript comprises a branch point and a functional 3' splice site. One aspect described herein relates to iExons, wherein the RNA transcript comprises two exons and an intron, wherein a first exon is upstream of the intron and a second exon is downstream of the intron, wherein the intron comprises in 5' to 3' order: a first 5' splice site, a first branch point, a first 3' splice site (also referred to as an iExon 3' splice site), an intronic REMS sequence, a second branch point and a second 3' splice site (see, for example, FIG. 1A). In this aspect, in the presence of a compound described herein, the intronic REMS sequence functions as a 5' splice site and will undergo splicing with the second 3' splice site, causing the NNGA nucleotides of the iREMS sequence and the intronic nucleotides downstream from the first 3' splice site to be retained and spliced as an intronic exon to provide a non-wild-type mRNA. Another aspect described herein relates to eExons (extended exons), wherein the RNA transcript comprises two exons and an intron, wherein a first exon is upstream of the intron and a second exon is downstream of the intron, wherein the intron comprises a RNA nucleotide sequence comprising in 5' to 3' order: an intronic REMS sequence, a branch point, and a 3' splice site (see, for example, see FIGS. 1B and 1C: Exon 1e and Exon 2e, respectively). In this aspect, in the presence of a compound described herein, the 5' splice site upstream of the iREMS splice site does not undergo splicing with the downstream 3' splice site. Instead, in the presence of a compound described herein, the iREMS sequence, in the presence of the downstream branchpoint, undergoes splicing with the downstream 3' splice site. In this aspect, the exon is extended from the 5' splice site by including one or more nucleotides into the mRNA transcript downstream of the annotated 5' splice site to the iREMS splice site.

In certain aspects, one or more sequence elements necessary to form an iExon may be present endogenously or non-endogenously, wherein the sequence elements are selected from the group consisting of an intronic RENTS, a branch point and an iExon 3' splice site. In other aspects, one or more additional sequence elements necessary to form an iExon may be present endogenously or non-endogenously, wherein the sequence elements are selected from the group consisting of a 5' splice site, a second branch point and a second 3' splice site for an exon. In another aspect for an iExon, the sequence elements necessary to form an iExon include an upstream iExon 3' splice site sequence, an intronic REMS sequence, a downstream branch point sequence and a downstream 3' splice site sequence. In another aspect, where an eExon (extended Exon) is formed, the sequence elements necessary to form an eExon include an intronic REMS sequence, a downstream branch point sequence and a downstream functional 3' splice site sequence. In certain aspects, one or more snRNPs and trans factor elements necessary for splicing may be present beyond endogenous levels as a result of the presence of a compound described herein at any of the various splice inducing sequence combinations described herein. Without being bound by any theory or mechanism, the small molecule compounds described herein, in conjunction with the iREMS sequence, initiate the assembly of a splicing-competent spliceosome around a weak or incompletely defined exon (i.e., a nascent iExon). Splicing modifier compounds most likely enable a functional U1 snRNP-REMS interaction and, at least, have been shown to increase the affinity of one or more snRNPs and trans factor elements necessary for splicing, including U1, U2, U4, U5 and U6, whereby the interaction between the U1 snRNP, as well as other components of the pre-mRNA splicing machinery, and the nucleotides NNGA of the REMS (which will be retained as part of the iExon or eExon) are enhanced. In fact, we have discovered that the interaction of the U1 snRNP, the iREMS and the small molecule splicing modifier compounds described herein serve to define nascent exons by increasing the binding affinity of the pre-mRNA splicing machinery to the iREMS sequence, stabilizing UT binding with the iREMS sequence, activating the iExon 3' splice site upstream from the iREMS (in the case of iExons) and recruiting U2 snRNP and other trans-acting splicing factors such as U2AF (U2AF65 and U2AF35) and SF3A (SF3A1, SF3A2 and SF3A3) to the downstream branch point and 3' splice site. The branch point and 3' splice site may or may not necessarily be partially or fully occupied by trans factors in the absence of the compound but have been shown to become more occupied after the compound has enabled the formation of a functional U1 snRNP iREMS complex. We have elaborated on the interaction of these key splicing machinery elements, showing that, in the presence of small molecule splicing modifier compounds such as, but certainly not limited to, those described herein, the mechanism of spliceosome assembly on a nascent iExon can be mediated by interaction of the iREMS sequence with such compounds, such that the intronic REMS sequence functions as a U1 snRNP binding site, resulting in intronic nucleotides spliced in the mature RNA transcript as a non-wild type intronic exon.

In FIG. 1A, the intronic REMS is located in Intron 1 downstream from an Exon 1 5' splice site (i.e., a 5' splice site at the 3' end of Exon 1), a first branch point (BP) sequence and a first iExon 3' splice site sequence and upstream from a second branch point sequence and a second 3' splice site sequence of Exon 2 in an RNA transcript (i.e., a precursor mRNA). In the presence of a small molecule splicing modifier compound described herein the iREMS sequence functions as a 5' splice site, whereby the nucleotides between the Exon 1 5' splice site and the first iExon 3' splice site are removed between Exon 1 and a nascent intronic exon and the nucleotides between the intronic REMS and the second 3' splice site are removed between iExon 1a and Exon 2, thus allowing Exon 2 and the portion of the intron comprising nucleotides from the first 3' splice site up to and including NNGA of the intronic REMS to be joined, thus introducing an intron-derived iExon 1a, generating a non-wildtype mRNA. In certain aspects of FIG. 1A, one or more elements necessary to induce splicing may be present endogenously or introduced and may be in any configuration capable of recognition by the splicing machinery as an "exon," wherein the one or more elements are selected from the group consisting of the intronic REMS, the first branch point, the first 3' splice site, the second branch point and the second 3' splice site. While illustrated for Intron 1 here, where the configuration in this instance results in a non-wild type iExon, this concept is generally applicable to any other intron in an RNA transcript.

In FIG. 1B, the intronic REMS is located in an intron of an RNA transcript downstream from an Exon 1 5' splice site (i.e., a 5' splice site at the 3' end of Exon 1) and upstream from an Intron 1 branch point sequence and a 3' splice site sequence of Exon 2 (i.e., a 3' splice site at the 5' end of Exon 2). In the presence of a small molecule splicing modifier compound described herein, the nucleotides between the Exon 1 5' splice site and the intronic RENTS are retained and those between the intronic REMS and the Intron 1 3' splice site sequence (except the NNGA nucleotides of the intronic REMS) are removed, allowing Exon 1 and the portion of the intron comprising nucleotides from those adjacent to the Exon 1 5' splice site up to and including NNGA of the intronic REMS and the Exon 2 nucleotides to be joined. While illustrated for Exon 1 here as an example of a particular configuration, this concept is generally applicable to any other exon that has another downstream exon. The elements necessary to induce splicing of an eExon may be present in any configuration capable of recognition by the splicing machinery as an "exon." Accordingly, in the presence of a splicing modifier compound, the spliceosome recognizes the elements as exonic boundaries for removal of intervening intronic nucleotides between those boundaries. The configuration in this instance results in an eExon, with an extension of the upstream exon at its 3' end.

In FIG. 1C, the intronic REMS is located in Intron 2 downstream from an Exon 2 5' splice site (i.e., a 5' splice site at the 3' end of Exon 2) and upstream from an Intron 2 branch point sequence and a 3' splice site sequence of Exon 3 (i.e., a 3' splice site at the 5' end of Exon 3) in an RNA transcript. In the presence of a small molecule splicing modifier compound described herein, the nucleotides between the intronic REMS and the Exon 3 3' splice site sequence are removed, allowing Exon 3 and the portion of the intron comprising nucleotides from those adjacent to the Exon 2 5' splice site up to and including NNGA of the intronic REMS to be joined. In this example, the endogenous splicing reaction between Exon 1 and Exon 2 is unaffected by the presence of a compound described herein, resulting in the complete removal of Intron 1. While illustrated for Exon 2 here, this concept is generally applicable to any other nascent exon, i.e., an exon that is located between at least one upstream exon and one downstream exon of the same pre-mRNA transcript.

As used herein, an "exon 5' splice site" or the like refers to a 5' splice site at the 3' end of the exon upstream from the iREMS sequence, while an "exon 3' splice site" or the like refers to a 3' splice site at the 5' end of the exon downstream from the iREMS sequence.

In the presence of a small molecule splicing modifier compound described herein, the iREMS nucleotides retained in the formation of an iExon or eExon are selected from the group consisting of ANGA, CNGA, GNGA, UNGA, NAGA, NCGA, NGGA, NUGA, AAGA, ACGA, AGGA, AUGA, CAGA, CCGA, CGGA, CUGA, GAGA, GCGA, GGGA, GUGA, UAGA, UCGA, UGGA and UUGA. The inclusion of an iExon or the formation of an eExon may result in an RNA transcript having an altered or truncated open reading frame due to the inclusion of a frame-maintaining sequence, frameshift, premature stop codon, or internal insertion or deletion (as a result of mutually exclusive alternative splicing) within the open reading frame. In other aspects resulting from non-mutually exclusive alternative splicing; the inclusion of an iExon or the formation of an eExon may result in the mature mRNA having a functional open reading frame, producing a novel protein which may or may not be functional or may be unstable and rapidly degraded. RNA transcripts having an altered or truncated open reading frame are expected to be present in low abundance and can be substrates for nonsense-mediated decay, nonstop-mediated decay, no-go decay, translation-dependent decay, iExon-mediated decapping, alternative 3' end formation and polyadenylation and thus have low abundance. Any intronic REMS-mediated alternative splicing modified RNA transcripts may also have altered stability; altered intracellular transport, altered 3' end formation efficiency and altered translation efficiency. In aspects described herein, the term "frame-maintaining sequence" refers to the inclusion of a sequence that alters the open reading frame but maintains nucleotide trimers between start and stop codon in the mature mRNA. In aspects described herein, the term "mutually exclusive alternative splicing" refers to the choice between two exons or exon groups of which exon or exon group of the two will be spliced. In other words, mutually exclusive splicing events are not independent, leaving only one of the exons or exon groups in a RNA to be spliced but not both (i.e., "mutually exclusive"). For example, inclusion of an iExon, per se, cannot result in a deletion. However, in a mutually exclusive alternative splicing event, such an inclusion may also result in exon skipping up or downstream of the iExon and a deletion when one exon or the other is spliced out. In other aspects described herein, the term "non-mutually exclusive alternative splicing" refers to independent splicing events in which one or the other or both exons or exon groups in a RNA may be spliced.

Accordingly, in one aspect, provided herein are methods for modulating the amount of RNA transcripts produced from precursor RNA containing an endogenous or non-endogenous intronic REMS. In another aspect, provided herein are artificial gene constructs comprising an endogenous or non-endogenous intronic REMS, which may be used in the context of, e.g., gene therapy or reporter assays. In another aspect, provided herein are methods for altering endogenous genes so that they contain an intronic REMS or an additional intronic REMS.

In another aspect, provided herein are methods for modulating the amount of one or more RNA transcripts (e.g., mRNA transcripts) or proteins thereof expressed as the product of one or more genes, wherein precursor RNA transcripts transcribed by the one or more genes comprise an intronic REMS, the methods comprising contacting a cell with a compound of Formula (I):

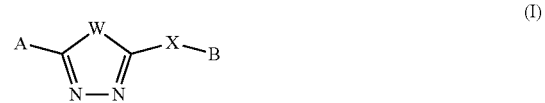

or a form thereof, wherein W, X, A and B are as defined herein.

In one aspect, provided herein is a method for modulating the amount of an RNA transcript produced from precursor RNA containing an Intronic Recognition Element for Splicing Modifier (iREMS), the method comprising contacting a cell containing the precursor RNA with a compound of Formula (I) or a form thereof, wherein the intronic REMS comprises the sequence NNGAgurngn (SEQ ID NO: 1), wherein r is adenine or guanine and n or N is any nucleotide, wherein the precursor RNA is a gene described herein. In another aspect, provided herein is a method for modulating the amount of an RNA transcript produced from precursor RNA containing an intronic recognition element for splicing modifier (REMS), the method comprising contacting the precursor RNA with a compound of Formula (I) or a form thereof, wherein the intronic REMS comprises the sequence NNGAgurngn (SEQ ID NO: 1), wherein r is adenine or guanine and n or N is any nucleotide, wherein the precursor RNA is a gene described herein. In some aspects, the intronic REVS comprises the sequence NNGAguragu (SEQ ID NO: 3) at the RNA level, wherein r is adenine or guanine and N is any nucleotide. In certain aspects, the intronic REMS comprises a sequence selected from the group consisting of ANGAgurngn (SEQ ID NO: 4), CNGAgurngn (SEQ ID NO: 5), GNGAgurngn (SEQ ID NO: 6), LNGAgurngn (SEQ ID NO: 7), NAGAgurngn (SEQ ID NO: 8), NCGAgurngn (SEQ ID NO: 9), NGGAgurngn (SEQ ID NO: 10), NUGAgurngn (SEQ ID NO: 11), AAGAgurngn (SEQ ID NO: 12), ACGAgurngn (SEQ ID NO: 13), AGGAgurngn (SEQ ID NO: 14), AUGAgurngn (SEQ ID NO: 15), CAGAgurngn (SEQ ID NO: 16), CCGAgurngn (SEQ ID NO: 17), CGGAgurngn (SEQ ID NO: 18), CUGAgurngn (SEQ ID NO: 19), GAGAgurngn (SEQ ID NO: 20), GCGAgurngn (SEQ ID NO: 21), GGGAgurngn (SEQ ID NO: 22), GUGAgurngn (SEQ ID NO: 23), UAGAgurngn (SEQ ID NO: 24), UCGAgurngn (SEQ ID NO: 25), UGGAgurngn (SEQ ID NO: 26) and UUGAgurngn (SEQ ID NO: 27), wherein r is adenine or guanine and n or N is any nucleotide.

In some aspects, the intronic REMS comprises a sequence selected from the group consisting of ANGAguragu (SEQ ID NO: 28), CNGAguragu (SEQ ID NO: 29), GNGAguragu (SEQ ID NO: 30), UNGAguragu (SEQ ID NO: 31), NAGAguragu (SEQ ID NO: 32), NCGAguragu (SEQ ID NO: 33), NGGAguragu (SEQ ID NO: 34), NUGAguragu (SEQ ID NO: 35), AAGAguragu (SEQ ID NO: 36), ACGAguragu (SEQ ID NO: 37), AGGAguragu (SEQ ID NO: 38), AUGAguragu (SEQ ID NO: 39), CAGAguragu (SEQ ID NO: 40), CCGAguragu (SEQ ID NO: 41), CGGAguragu (SEQ ID NO: 42), CUGAguragu (SEQ ID NO: 43), GAGAguragu (SEQ ID NO: 44), GCGAguragu (SEQ ID NO: 45), GGGAguragu (SEQ ID NO: 46), GUGAguragu (SEQ ID NO: 47), UAGAguragu (SEQ ID NO: 48), UCGAguragu (SEQ ID NO: 49), UGGAguragu (SEQ ID NO: 50) and UUGAguragu (SEQ ID NO: 51) at the RNA level, wherein r is adenine or guanine, and N is any nucleotide. In one or more aspects provided herein, N is adenine or guanine.

In a specific aspect, the intronic REMS referred to in a method or artificial gene construct described herein comprises, at the RNA level, a sequence presented in Table 1 (wherein r is adenine or guanine, and n or N is any nucleotide):

TABLE 1

Intronic REMS RNA sequence
(wherein r is adenine or guanine, and n or N is any nucleotide)

| SEQ ID NO. | Sequence | SEQ ID NO. | Sequence | SEQ ID NO. | Sequence | SEQ ID NO. | Sequence |
|---|---|---|---|---|---|---|---|
| 4 | ANGAgurngn | 5 | CNGAgurngn | 6 | GNGAgurngn | 7 | UNGAgurngn |
| 8 | NAGAgurngn | 9 | NCGAgurngn | 10 | NGGAgarngn | 11 | NUGAgurngn |
| 12 | AAGAgurngn | 13 | ACGAgurngn | 14 | AGGAgurngn | 15 | AUGAgurngn |
| 16 | CAGAgurngn | 17 | CCGAgurngn | 18 | CGGAgurngn | 19 | CUGAgurngn |
| 20 | GAGAgurngn | 21 | GCGAgurngn | 22 | GGGAgarngn | 23 | GUGAgurngn |
| 24 | UAGAgurngn | 25 | UCGAgurngn | 52 | UGGAgurngn | 53 | UUGAgurngn |
| 54 | ANGAguragn | 55 | ANGAgurcgn | 56 | ANGAgurggn | 57 | ANGAgurugn |
| 58 | NAGAguragn | 59 | NAGAgurcgn | 60 | NAGAgurggn | 61 | NAGAgurugn |
| 62 | AAGAguragn | 63 | AAGAgurcgn | 64 | AAGAgurggn | 65 | AAGAgurugn |
| 66 | CAGAguragn | 67 | CAGAgurcgn | 68 | CAGAgurggn | 69 | CAGAgurugn |
| 70 | GAGAguragn | 71 | GAGAgurcgn | 72 | GAGAgurggn | 73 | GAGAgutugn |
| 74 | UAGAguragn | 75 | UAGAgurcgn | 76 | UAGAgurggn | 77 | UAGAgurugn |
| 78 | CNGAguragn | 79 | CNGAgurcgn | 80 | CNGAgurggn | 81 | CNGAguragn |
| 82 | NCGAguragn | 83 | NCGAgurcgn | 84 | NCGAgurggn | 85 | NCGAgugugn |
| 86 | ACGAguragn | 87 | ACGAgurcgn | 88 | ACGAgurggn | 89 | ACGAgurugn |
| 90 | CCGAguragn | 91 | CCGAgurcgn | 92 | CCGAgurggn | 93 | CCGAgurugn |
| 94 | GCGAguragn | 95 | GCGAgurcgn | 96 | GCGAgurggn | 97 | GCGAgugugn |
| 98 | UCGAguragn | 99 | UCGAgurcgn | 100 | UCGAgurggn | 101 | UCGAgurugn |
| 102 | GNGAguragn | 103 | GNGAgurcgn | 104 | GNGAgurggn | 105 | GNGAgurugn |
| 106 | NGGAguragn | 107 | NGGAgurcgn | 108 | NGGAgurggn | 109 | NGGAgurugn |
| 110 | AGGAguragn | 111 | AGGAgugcgn | 112 | AGGAgurggn | 113 | AGGAgurugn |
| 114 | CGGAguragn | 115 | CGGAgurcgn | 116 | CGGAgurggn | 117 | CGGAgurugn |
| 118 | GGGAguragn | 119 | GGGAgurcgn | 120 | GGGAgurggn | 121 | GGGAgurugn |
| 122 | UGGAguragn | 123 | UGGAgurcgn | 124 | UGGAgurggn | 125 | UGGAgurugn |
| 126 | UNGAguragn | 127 | UNGAgurcgn | 128 | UNGAgurggn | 129 | UNGAgurugn |
| 130 | NUGAguragn | 131 | NUGAgurcgn | 132 | NUGAgurggn | 133 | NUGAgurugn |
| 134 | AUGAguragn | 135 | AUGAgurcgn | 136 | AUGAgurggn | 137 | AUGAgurugn |
| 138 | CUGAgurngn | 139 | CUGAgurcgn | 140 | CUGAgurggn | 141 | CUGAgurugn |
| 142 | GUGAguragn | 143 | GUGAgurcgn | 144 | GUGAgurggn | 145 | GUGAgurugn |
| 146 | UUGAguragn | 147 | UUGAgurcgn | 148 | UUGAgurggn | 149 | UUGAgurugn |
| 150 | ANGAguraga | 151 | ANGAgurcga | 152 | ANGAgurgga | 153 | ANGAguruga |
| 154 | NAGAguraga | 155 | NAGAgurcga | 156 | NAGAgurgga | 157 | NAGAguruga |
| 158 | AAGAguraga | 159 | AAGAgurcga | 160 | AAGAgurgga | 161 | AAGAguruga |
| 162 | CAGAguraga | 163 | CAGAgurcga | 164 | CAGAgurgga | 165 | CAGAguruga |

TABLE 1-continued

Intronic REMS RNA sequence
(wherein r is adenine or guanine, and n or N is any nucleotide)

| SEQ ID NO. | Sequence | SEQ ID NO. | Sequence | SEQ ID NO. | Sequence | SEQ ID NO. | Sequence |
|---|---|---|---|---|---|---|---|
| 166 | GAGAguraga | 167 | GAGAgurcga | 168 | GAGAgurgga | 169 | GAGAguruga |
| 170 | UAGAguraga | 171 | UAGAgurcga | 172 | UAGAgurgga | 173 | UAGAguruga |
| 174 | CNGAguraga | 175 | CNGAgurcga | 176 | CNGAgurgga | 177 | CNGAguruga |
| 178 | NCGAguraga | 179 | NCGAgurcga | 180 | NCGAgurgga | 181 | NCGAguruga |
| 182 | ACGAguraga | 183 | ACGAgurcga | 184 | ACGAgurgga | 185 | ACGAguruga |
| 186 | CCGAguraga | 187 | CCGAgurcga | 188 | CCGAgurgga | 189 | CCGAguruga |
| 190 | GCGAguraga | 191 | GCGAgurcga | 192 | GCGAgurgga | 193 | GCGAguruga |
| 194 | UCGAguraga | 195 | UCGAgurcga | 196 | UCGAgurgga | 197 | UCGAguruga |
| 198 | GNGAguraga | 199 | GNGAgurcga | 200 | GNGAgurgga | 201 | GNGAguruga |
| 202 | NGGAguraga | 203 | NGGAgurcga | 204 | NGGAgurgga | 205 | NGGAguruga |
| 206 | AGGAguraga | 207 | AGGAgurcga | 208 | AGGAgurgga | 209 | AGGAguruga |
| 210 | CGGAguraga | 211 | CGGAgurcga | 212 | CGGAgurgga | 213 | CGGAguruga |
| 214 | GGGAguraga | 215 | GGGAgurcga | 216 | GGGAgurgga | 217 | GGGAguruga |
| 218 | UGGAguraga | 219 | UGGAgurcga | 220 | UGGAgurgga | 221 | UGGAguruga |
| 222 | UNGAguraga | 223 | UNGAgurcga | 224 | UNGAgurgga | 225 | UNGAguruga |
| 226 | NUGAguraga | 227 | NUGAgurcga | 228 | NUGAgurgga | 229 | NUGAguruga |
| 230 | AUGAguraga | 231 | AUGAgurcga | 232 | AUGAgurgga | 233 | AUGAguruga |
| 234 | CUGAguraga | 235 | CUGAgurcga | 236 | CUGAgurgga | 237 | CUGAguruga |
| 238 | GUGAguraga | 239 | GUGAgurcga | 240 | GUGAgurgga | 241 | GUGAguruga |
| 242 | UUGAguraga | 243 | UUGAgurcga | 244 | UUGAgurgga | 245 | UUGAguruga |
| 246 | ANGAguragc | 247 | ANGAgurcgc | 248 | ANGAgurggc | 249 | ANGAgurngc |
| 250 | NAGAguragc | 251 | NAGAgarcgc | 252 | NAGAgarggc | 253 | NAGAgurugc |
| 254 | AAGAguragc | 255 | AAGAgurcgc | 256 | AAGAgurggc | 257 | AAGAgurugc |
| 258 | CAGAguragc | 259 | CAGAgurcgc | 260 | CAGAgurggc | 261 | CAGAgurugc |
| 262 | GAGAguragc | 263 | GAGAgurcgc | 264 | GAGAgurggc | 265 | GAGAgutugc |
| 266 | UAGAguragc | 267 | UAGAgurcgc | 268 | UAGAgurggc | 269 | UAGAgurugc |
| 270 | CNGAguragc | 271 | CNGAgurcgc | 272 | CNGAgurggc | 273 | CNGAgurugc |
| 274 | NCGAguragc | 275 | NCGAgurcgc | 276 | NCGAgurggc | 277 | NCGAgurugc |
| 278 | ACGAguragc | 279 | ACGAgurcgc | 280 | ACGAgurggc | 281 | ACGAgurugc |
| 282 | CCGAguragc | 283 | CCGAgurcgc | 284 | CCGAgurggc | 285 | CCGAgurugc |
| 286 | GCGAguragc | 287 | GCGAgurcgc | 288 | GCGAgurggc | 289 | GCGAgurugc |
| 290 | UCGAguragc | 291 | UCGAgurcgc | 292 | UCGAgurggc | 293 | UCGAgurugc |
| 294 | GNGAguragc | 295 | GNGAgurcgc | 296 | GNGAgurggc | 297 | GNGAgurugc |
| 298 | NGGAguragc | 299 | NGGAgurcgc | 300 | NGGAgurggc | 301 | NGGAgurugc |
| 302 | AGGAguragc | 303 | AGGAgurcgc | 304 | AGGAgarggc | 305 | AGGAgurugc |
| 306 | CGGAguragc | 307 | CGGAgurcgc | 308 | CGGAgurggc | 309 | CGGAgurugc |
| 310 | GGGAguragc | 311 | GGGAgurcgc | 312 | GGGAgurggc | 313 | GGGAgurugc |
| 314 | UGGAguragc | 315 | UGGAgarcgc | 316 | UGGAgarggc | 317 | UGGAgurugc |

TABLE 1-continued

Intronic REMS RNA sequence
(wherein r is adenine or guanine, and n or N is any nucleotide)

| SEQ ID NO. | Sequence | SEQ ID NO. | Sequence | SEQ ID NO. | Sequence | SEQ ID NO. | Sequence |
|---|---|---|---|---|---|---|---|
| 318 | UNGAguragc | 319 | UNGAgurcgc | 320 | UNGAgurggc | 321 | UNGAgurugc |
| 322 | NUGAguragc | 323 | NUGAgurcgc | 324 | NUGAgurggc | 325 | NUGAgurngc |
| 326 | AUGAguragc | 327 | AUGAgarcgc | 328 | AUGAgarggc | 329 | AUGAgurugc |
| 330 | CUGAguragc | 331 | CUGAgurcgc | 332 | CUGAgurggc | 333 | CUGAgurugc |
| 334 | GUGAguragc | 335 | GUGAgurcgc | 336 | GUGAgurggc | 337 | GUGAgurngc |
| 338 | UUGAguragc | 339 | UUGAgurcgc | 340 | UUGAgurggc | 341 | UUGAgurugc |
| 342 | ANGAguragg | 343 | ANGAgurcgg | 344 | ANGAgurggg | 345 | ANGAgurugg |
| 346 | NAGAguragg | 347 | NAGAgurcgg | 348 | NAGAgurggg | 349 | NAGAgurugg |
| 350 | AAGAguragg | 351 | AAGAgurcgg | 352 | AAGAgurggg | 353 | AAGAgurugg |
| 354 | CAGAguragg | 355 | CAGAgurcgg | 356 | CAGAgurggg | 357 | CAGAgurugg |
| 358 | GAGAguragg | 359 | GAGAgurcgg | 360 | GAGAgurggg | 361 | GAGAgurugg |
| 362 | UAGAguragg | 363 | UAGAgurcgg | 364 | UAGAgurggg | 365 | UAGAgurugg |
| 366 | CNGAguragg | 367 | CNGAgurcgg | 368 | CNGAgurggg | 369 | CNGAgurugg |
| 370 | NCGAguragg | 371 | NCGAgurcgg | 372 | NCGAgurggg | 373 | NCGAgurugg |
| 374 | ACGAguragg | 375 | ACGAgurcgg | 376 | ACGAgurggg | 377 | ACGAgurugg |
| 378 | CCGAguragg | 379 | CCGAgurcgg | 380 | CCGAgurggg | 381 | CCGAgurugg |
| 382 | GCGAguragg | 383 | GCGAgurcgg | 384 | GCGAgurggg | 385 | GCGAgurugg |
| 386 | UCGAguragg | 387 | UCGAgurcgg | 388 | UCGAgurggg | 389 | UCGAgurugg |
| 390 | GNGAguragg | 391 | GNGAgurcgg | 392 | GNGAgurggg | 393 | GNGAgurugg |
| 394 | NGGAguragg | 395 | NGGAgurcgg | 396 | NGGAgurggg | 397 | NGGAgurugg |
| 398 | AGGAguragg | 399 | AGGAgurcgg | 400 | AGGAgurggg | 401 | AGGAgurugg |
| 402 | CGGAguragg | 403 | CGGAgurcgg | 404 | CGGAgurggg | 405 | CGGAgurugg |
| 406 | GGGAguragg | 407 | GGGAgurcgg | 408 | GGGAgurggg | 409 | GGGAgurugg |
| 410 | UGGAguragg | 411 | UGGAgurcgg | 412 | UGGAgurggg | 413 | UGGAgurugg |
| 414 | UNGAguragg | 415 | UNGAgurcgg | 416 | UNGAgurggg | 417 | UNGAgurugg |
| 418 | NUGAguragg | 419 | NUGAgurcgg | 420 | NUGAgurggg | 421 | NUGAgurugg |
| 422 | AUGAguragg | 423 | AUGAgUrcgg | 424 | AUGAgurggg | 425 | AUGAgurugg |
| 426 | CUGAguragg | 427 | CUGAgurcgg | 428 | CUGAgurggg | 429 | CUGAgurugg |
| 430 | GUGAguragg | 431 | GUGAgurcgg | 432 | GUGAgurggg | 433 | GUGAgurugg |
| 434 | UUGAguragg | 435 | UUGAgurcgg | 436 | UUGAgurggg | 437 | UUGAgurugg |
| 28 | ANGAguragu | 438 | ANGAgurcgu | 439 | ANGAgurggu | 440 | ANGAgurugu |
| 32 | NAGAguragu | 441 | NAGAgurcgu | 442 | NAGAgurggu | 443 | NAGAgurugu |
| 36 | AAGAguragu | 444 | AAGAgurcgu | 445 | AAGAgurggu | 446 | AAGAgurugu |
| 40 | CAGAguragu | 447 | CAGAgurcgu | 448 | CAGAgurggu | 449 | CAGAgurugu |
| 44 | GAGAguragu | 450 | GAGAgurcgu | 451 | GAGAgurggu | 452 | GAGAgurugu |
| 48 | UAGAguragu | 453 | UAGAgurcgu | 454 | UAGAgurggu | 455 | UAGAgurugu |
| 29 | CNGAguragu | 456 | CNGAgurcgu | 457 | CNGAgurggu | 458 | CNGAgurugu |

TABLE 1-continued

Intronic REMS RNA sequence
(wherein r is adenine or guanine, and n or N is any nucleotide)

| SEQ ID NO. | Sequence | SEQ ID NO. | Sequence | SEQ ID NO. | Sequence | SEQ ID NO. | Sequence |
|---|---|---|---|---|---|---|---|
| 33 | NCGAguragu | 459 | NCGAgurcgu | 460 | NCGAgurggu | 461 | NCGAgurugu |
| 37 | ACGAguragu | 462 | ACGAgurcgu | 463 | ACGAgurggu | 464 | ACGAgurugu |
| 41 | CCGAguragu | 465 | CCGAgurcgu | 466 | CCGAgurggu | 467 | CCGAgurugu |
| 45 | GCGAguragu | 468 | GCGAgurcgu | 469 | GCGAgurggu | 470 | GCGAgurugu |
| 49 | UCGAguragu | 471 | UCGAgurcgu | 472 | UCGAgurggu | 473 | UCGAgurugu |
| 30 | GNGAguragu | 474 | GNGAgurcgu | 475 | GNGAgurggu | 476 | GNGAgurugu |
| 34 | NGGAguragu | 477 | NGGAgurcgu | 478 | NGGAgurggu | 479 | NGGAgurugu |
| 38 | AGGAguragu | 480 | AGGAgurcgu | 481 | AGGAgurggu | 482 | AGGAgurugu |
| 42 | CGGAguragu | 483 | CGGAgurcgu | 484 | CGGAgurggu | 485 | CGGAgurugu |
| 46 | GGGAguragu | 486 | GGGAgurcgu | 487 | GGGAgurggu | 488 | GGGAgurugu |
| 489 | UGGAguragu | 490 | UGGAgurcgu | 491 | UGGAgurggu | 492 | UGGAgurugu |
| 31 | UNGAguragu | 493 | UNGAgurcgu | 494 | UNGAgurggu | 495 | UNGAgurugu |
| 35 | NUGAguragu | 496 | NUGAgurcgu | 497 | NUGAgurggu | 498 | NUGAgurugu |
| 39 | AUGAguragu | 499 | AUGAgurcgu | 500 | AUGAgurggu | 501 | AUGAgurugu |
| 43 | CUGAguragu | 502 | CUGAgurcgu | 503 | CUGAgurggu | 504 | CUGAgurugu |
| 47 | GUGAguragu | 505 | GUGAgurcgu | 506 | GUGAgurggu | 507 | GUGAgurugu |
| 508 | UUGAguragu | 509 | UUGAgurcgu | 510 | UUGAgurggu | 511 | UUGAgurugu |
| 512 | ANGAgurnga | 513 | ANGAgurngc | 514 | ANGAgurngg | 515 | ANGAgurngu |
| 516 | NAGAgurnga | 517 | NAGAgurngc | 518 | NAGAgurngg | 519 | NAGAgurngu |
| 520 | AAGAgurnga | 521 | AAGAgurngc | 522 | AAGAgurngg | 523 | AAGAgurngu |
| 524 | CAGAgurnga | 525 | CAGAgurngc | 526 | CAGAgurngg | 527 | CAGAgurngu |
| 528 | GAGAgurnga | 529 | GAGAgurngc | 530 | GAGAgurngg | 531 | GAGAgurngu |
| 532 | UAGAgurnga | 533 | UAGAgurngc | 534 | UAGAgurngg | 535 | UAGAgurngu |
| 536 | CNGAgurnga | 537 | CNGAgurngc | 538 | CNGAgurngg | 539 | CNGAgurngu |
| 540 | NCGAgurnga | 541 | NCGAgurngc | 542 | NCGAguragg | 543 | NCGAgurngu |
| 544 | ACGAgurnga | 545 | ACGAgurngc | 546 | ACGAgurngg | 547 | ACGAgurngu |
| 548 | CCGAgurnga | 549 | CCGAgurngc | 550 | CCGAgurngg | 551 | CCGAgurngu |
| 552 | GCGAgurnga | 553 | GCGAgurngc | 554 | GCGAgurngg | 555 | GCGAgurngu |
| 556 | UCGAgurnga | 557 | UCGAgurngc | 558 | UCGAgurngg | 559 | UCGAgurngu |
| 560 | GNGAgurnga | 561 | GNGAgurngc | 562 | GNGAgurngg | 563 | GNGAgurngu |
| 564 | NGGAgurnga | 565 | NGGAgurngc | 566 | NGGAgurngg | 567 | NGGAgurngu |
| 568 | AGGAgurnga | 569 | AGGAgurngc | 570 | AGGAgurngg | 571 | AGGAgurngu |
| 572 | CGGAgurnga | 573 | CGGAgurngc | 574 | CGGAgurngg | 575 | CGGAgurngu |
| 576 | GGGAgurnga | 577 | GGGAgurngc | 578 | GGGAgurngg | 579 | GGGAgurngu |
| 580 | UGGAgurnga | 581 | UGGAgurngc | 582 | UGGAgurngg | 583 | UGGAgurngu |
| 584 | UNGAgurnga | 585 | UNGAgurngc | 586 | UNGAgurngg | 587 | UNGAgurngu |
| 588 | NUGAgurnga | 589 | NUGAgurngc | 590 | NUGAgurngg | 591 | NUGAgurngu |
| 592 | AUGAgurnga | 593 | AUGAgurngc | 594 | AUGAgurngg | 595 | AUGAgurngu |

TABLE 1-continued

Intronic REMS RNA sequence
(wherein r is adenine or guanine, and n or N is any nucleotide)

| SEQ ID NO. | Sequence | SEQ ID NO. | Sequence | SEQ ID NO. | Sequence | SEQ ID NO. | Sequence |
|---|---|---|---|---|---|---|---|
| 596 | CUGAgurnga | 597 | CUGAgurngc | 598 | CUGAgurngg | 599 | CUGAgurngu |
| 600 | GUGAgurnga | 601 | GUGAgurngc | 602 | GUGAgurngg | 603 | GUGAgurngu |
| 604 | UUGAgurnga | 605 | UUGAgurngc | 606 | UUGAgurngg | 607 | UUGAgurngu |
| 608 | ANGAguangn | 609 | ANGAguaagn | 610 | ANGAguacgn | 611 | ANGAguaggn |
| 612 | NAGAguangn | 613 | NAGAguaagn | 614 | NAGAguacgn | 615 | NAGAguaggn |
| 616 | AAGAguangn | 617 | AAGAguaagn | 618 | AAGAguacgn | 619 | AAGAguaggn |
| 620 | CAGAguangn | 621 | CAGAguaagn | 622 | CAGAguacgn | 623 | CAGAguaggn |
| 624 | GAGAguangn | 625 | GAGAguaagn | 626 | GAGAguacgn | 627 | GAGAguaggn |
| 628 | UAGAguangn | 629 | UAGAguaagn | 630 | UAGAguacgn | 631 | UAGAguaggn |
| 632 | CNGAguangn | 633 | CNGAguaagn | 634 | CNGAguacga | 635 | CNGAguaggn |
| 636 | NCGAguangn | 637 | NCGAguaagn | 638 | NCGAguacgn | 639 | NCGAguaggn |
| 640 | ACGAguangn | 641 | ACGAguaagn | 642 | ACGgnacgn | 643 | ACGAguaggn |
| 644 | CCGAguangn | 645 | CCGAguaagn | 646 | CCGAguacgn | 647 | CCGAguaggn |
| 648 | GCGAguangn | 649 | GCGAguaagn | 650 | GCGAguacgn | 651 | GCGAguaggn |
| 657 | UCGAguangn | 653 | UCGAguaagn | 654 | UCGAgnacgn | 655 | UCGAguaggn |
| 656 | GNGAguangn | 657 | GNGAguaagn | 658 | GNGAguacgn | 659 | GNGAguaggn |
| 660 | NGGAguangn | 661 | NGGAguaagn | 662 | NGGAguacgn | 663 | NGGAguaggn |
| 664 | AGGAguangn | 665 | AGGAguaagn | 666 | AGGAguacgn | 667 | AGGAguaggn |
| 668 | CGGAguangn | 669 | CGGAguaagn | 670 | CGGAguacrn | 671 | CGGAguaggn |
| 672 | GGGAguangn | 673 | GGGAguaagn | 674 | GGGAguacgn | 675 | GGGAguaggn |
| 676 | UGGAguangn | 677 | UGGAguaagn | 678 | UGGAguacgn | 679 | UGGAguaggn |
| 680 | UNGAguangn | 681 | UNGAguaagn | 682 | UNGAguacgn | 683 | UNGAguaggn |
| 684 | NUGAguangn | 685 | NUGAguaagn | 686 | NUGAguacgn | 687 | NUGAguaggn |
| 688 | AUGAguangn | 689 | AUGAguaagn | 690 | AUGAguacgn | 691 | AUGAguaggn |
| 692 | CUGAguangn | 693 | CUGAguaagn | 694 | CUGAguacgn | 695 | CUGAguaggn |
| 696 | GUGAguangn | 697 | GUGAguaagn | 698 | GUGAguacgn | 699 | GUGAguaggn |
| 700 | UUGAguangn | 701 | UUGAguaagn | 702 | UTGAguacgn | 703 | UUGAguaggn |
| 704 | ANGAguaugn | 705 | ANGAguaaga | 706 | ANGAguacga | 707 | ANGAguagga |
| 708 | NAGAguaugn | 709 | NAGAguaaga | 710 | NAGAguacga | 711 | NAGAguagga |
| 712 | AAGAguaugn | 713 | AAGAguaaga | 714 | AAGAguacga | 715 | AAGAguagga |
| 716 | CAGAguaugn | 717 | CAGAguaaga | 718 | CAGAguacga | 719 | CAGAguagga |
| 720 | GAGAguaugn | 721 | GAGAguaaga | 722 | GAGAguacga | 723 | GAGAguagga |
| 724 | UAGAguaugn | 725 | UAGAguaaga | 726 | UAGAguacga | 727 | UAGAguagga |
| 728 | CNGAguaugn | 729 | CNGAguaaga | 730 | CNGAguacga | 731 | CNGAguagga |
| 732 | NCGAguaugn | 733 | NCGAguaaga | 734 | NCGAguacga | 735 | NCGAguagga |
| 736 | ACGAguaugn | 737 | ACGAguaaga | 738 | ACGAguacga | 739 | ACGAguagga |
| 740 | CCGAguaugn | 741 | CCGAguaaga | 742 | CCGAguacga | 743 | CCGAguagga |

TABLE 1-continued

Intronic REMS RNA sequence
(wherein r is adenine or guanine, and n or N is any nucleotide)

| SEQ ID NO. | Sequence | SEQ ID NO. | Sequence | SEQ ID NO. | Sequence | SEQ ID NO. | Sequence |
|---|---|---|---|---|---|---|---|
| 744 | GCGAguaugn | 745 | GCGAguaaga | 746 | GCGAguacga | 747 | GCGAguagga |
| 748 | UCGAguaugn | 749 | UCGAguaaga | 750 | UCGAguacga | 751 | UCGAguagga |
| 752 | GNGAguaugn | 753 | GNGAguaaga | 754 | GNGAguacga | 755 | GNGAguagga |
| 756 | NGGAguaugn | 757 | NGGAguaaga | 758 | NGGAguacga | 759 | NGGAguagga |
| 760 | AGGAguaugu | 761 | AGGAguaaga | 762 | AGGAguacga | 763 | AGGAguagga |
| 764 | CGGAguaugn | 765 | CGGAguaaga | 766 | CGGAguacga | 767 | CGGAguagga |
| 768 | GGGAguaugn | 769 | GGGAguaaga | 770 | GGGAguacga | 771 | GGGAguagga |
| 772 | UGGAguaugn | 773 | UGGAguaaga | 774 | UGGAguacga | 775 | UGGAguagga |
| 776 | UNGAguaugn | 777 | UNGAguaaga | 778 | UNGAguacga | 779 | UNGAguagga |
| 780 | NUGAguaugn | 781 | NUGAguaaga | 782 | NUGAguacga | 783 | NUGAguagga |
| 784 | AUGAguaugn | 785 | AUGAguaaga | 786 | AUGAguacga | 787 | AUGAguagga |
| 788 | CUGAguaugn | 789 | CUGAguaaga | 790 | CUGAguacga | 791 | CUGAguagga |
| 792 | GUGAguaugn | 793 | GUGAguaaga | 794 | GUGAguacga | 795 | GUGAguagga |
| 796 | UUGAguaugn | 797 | UUGAguaaga | 798 | UUGAguacga | 799 | UUGAguagga |
| 800 | ANGAguauga | 801 | ANGAguaagc | 802 | ANGAguacgc | 803 | ANGAguaggc |
| 804 | NAGAguauga | 805 | NAGAguaagc | 806 | NAGAguacgc | 807 | NAGAguaggc |
| 808 | AAGAguauga | 809 | AAGAguaagc | 810 | AAGAguacgc | 811 | AAGAguaggc |
| 812 | CAGAguauga | 813 | CAGAguaagc | 814 | CAGAguacgc | 815 | CAGAguaggc |
| 816 | GAGAguauga | 817 | GAGAguaagc | 818 | GAGAguacgc | 819 | GAGAguaggc |
| 820 | UAGAguauga | 821 | UAGAguaagc | 822 | UAGAguacgc | 823 | UAGAguaggc |
| 824 | CNGAguauga | 825 | CNGAguaagc | 826 | CNGAguacgc | 827 | CNGAguaggc |
| 828 | NCGAguauga | 829 | NCGAguaagc | 830 | NCGAguacgc | 831 | NCGAguaggc |
| 832 | ACGAguauga | 833 | ACGAguaagc | 834 | ACGAguacgc | 835 | ACGAguaggc |
| 836 | CCGAguauga | 837 | CCGAguaagc | 838 | CCGAguacgc | 839 | CCGAguaggc |
| 840 | GCGAguauga | 841 | GCGAguaagc | 842 | GCGAguacgc | 843 | GCGAguaggc |
| 844 | UCGAguauga | 845 | UCGAguaagc | 846 | UCGAguacgc | 847 | UCGAguaggc |
| 848 | GNGAguauga | 849 | GNGAguaagc | 850 | GNGAguacgc | 851 | GNGAguaggc |
| 852 | NGGAguauga | 853 | NGGAguaagc | 854 | NGGAguacgc | 855 | NGGAguaggc |
| 856 | AGGAguauga | 857 | AGGAguaagc | 858 | AGGAguacgc | 859 | AGGAguaggc |
| 860 | CGGAguauga | 861 | CGGAguaagc | 862 | CGGAguacgc | 863 | CGGAguaggc |
| 864 | GGGAguauga | 865 | GGGAguaagc | 866 | GGGAguacgc | 867 | GGGAguaggc |
| 868 | UGGAguauga | 869 | UGGAguaagc | 870 | UGGAguacgc | 871 | UGGAguaggc |
| 872 | UNGAguauga | 873 | UNGAguaagc | 874 | UNGAguacgc | 875 | UNGAguaggc |
| 876 | NUGAguauga | 877 | NUGAguaagc | 878 | NUGAguacgc | 879 | NUGAguaggc |
| 880 | AUGAguauga | 881 | AUGAguaagc | 882 | AUGAguacgc | 883 | AUGAguaggc |
| 884 | CUGAguauga | 885 | CUGAguaagc | 886 | CUGAguacgc | 887 | CUGAguaggc |
| 888 | GUGAguauga | 889 | GUGAguaagc | 890 | GUGAguacgc | 891 | GUGAguaggc |
| 892 | UUGAguauga | 893 | UUGAguaagc | 894 | UUGAguacgc | 895 | UUGAguaggc |

TABLE 1-continued

Intronic REMS RNA sequence
(wherein r is adenine or guanine, and n or N is any nucleotide)

| SEQ ID NO. | Sequence | SEQ ID NO. | Sequence | SEQ ID NO. | Sequence | SEQ ID NO. | Sequence |
|---|---|---|---|---|---|---|---|
| 896 | ANGAguaugc | 897 | ANGAguaagg | 898 | ANGAguacgg | 899 | ANGAguaggg |
| 900 | NAGAguaugc | 901 | NAGAguaagg | 902 | NAGAguacgg | 903 | NAGAguaggg |
| 904 | AAGAguaugc | 905 | AAGAguaagg | 906 | AAGAguacgg | 907 | AAGAguaggg |
| 908 | CAGAguaugc | 909 | CAGAguaagg | 910 | CAGAguacgg | 911 | CAGAguaggg |
| 912 | GAGAguaugc | 913 | GAGAguaagg | 914 | GAGAguacgg | 915 | GAGAguaggg |
| 916 | UAGAguaugc | 917 | UAGAguaagg | 918 | UAGAguacgg | 919 | UAGAguaggg |
| 920 | CNGAguaugc | 921 | CNGAguaagg | 922 | CNGAguacgg | 923 | CNGAguaggg |
| 924 | NCGAguaugc | 925 | NCGAguaagg | 926 | NCGAguacgg | 927 | NCGAguaggg |
| 928 | ACGAguaugc | 929 | ACGAguaagg | 930 | ACGAguacgg | 931 | ACGAguaggg |
| 932 | CCGAguaugc | 933 | CCGAguaagg | 934 | CCGAguacgg | 935 | CCGAguaggg |
| 936 | GCGAguaugc | 937 | GCGAguaagg | 938 | GCGAguacgg | 939 | GCGAguaggg |
| 940 | UCGAguaugc | 941 | UCGAguaagg | 942 | UCGAguacgg | 943 | UCGAguaggg |
| 944 | GNGAguaugc | 945 | GNGAguaagg | 946 | GNGAguacgg | 947 | GNGAguaggg |
| 948 | NGGAguaugc | 949 | NGGAguaagg | 950 | NGGAguacgg | 951 | NGGAguaggg |
| 957 | AGGAguaugc | 953 | AGGAguaagg | 954 | AGGAguacgg | 955 | AGGAguaggg |
| 956 | CGGAguaugc | 957 | CGGAguaagg | 958 | CGGAguacgg | 959 | CGGAguaggg |
| 960 | GGGAguaugc | 961 | GGGAguaagg | 962 | GGGAguacgg | 963 | GGGAguaggg |
| 964 | UGGAguaugc | 965 | UGGAguaagg | 966 | UGGAguacgg | 967 | UGGAguaggg |
| 968 | UNGAguaugc | 969 | UNGAguaagg | 970 | UNGAguacgg | 971 | UNGAguaggg |
| 972 | NUGAguaugc | 973 | NUGAguaagg | 974 | NUGAguacgg | 975 | NUGAguaggg |
| 976 | AUGAguaugc | 977 | AUGAguaagg | 978 | AUGAguacgg | 979 | AUGAguaggg |
| 980 | CUGAguaugc | 981 | CUGAguaagg | 982 | CUGAguacgg | 983 | CUGAguaggg |
| 984 | GUGAguaugc | 985 | GUGAguaagg | 986 | GUGAguacgg | 987 | GUGAguaggg |
| 988 | UUGAguaugc | 989 | UUGAguaagg | 990 | UUGAguacgg | 991 | UUGAguaggg |
| 992 | ANGAguaugg | 993 | ANGAguaagu | 994 | ANGAguacgu | 995 | ANGAguaggu |
| 996 | NAGAguaugg | 997 | NAGAguaagu | 998 | NAGAguacgu | 999 | NAGAguaggu |
| 1000 | AAGAguaugg | 1001 | AAGAguaagu | 1002 | AAGAguacgu | 1003 | AAGAguaggu |
| 1004 | CAGAguaugg | 1005 | CAGAguaagu | 1006 | CAGAguacgu | 1007 | CAGAguaggu |
| 1008 | GAGAguaugg | 1009 | GAGAguaagu | 1010 | GAGAguacgu | 1011 | GAGAguaggu |
| 1012 | UAGAguaugg | 1013 | UAGAguaagu | 1014 | UAGAguacgu | 1015 | UAGAguaggu |
| 1016 | CNGAguaugg | 1017 | CNGAguaagu | 1018 | CNGAguacgu | 1019 | CNGAguaggu |
| 1020 | NCGAguaugg | 1021 | NCGAguaagu | 1022 | NCGAguacgu | 1023 | NCGAguaggu |
| 1024 | ACGAguaugg | 1025 | ACGAguaagu | 1026 | ACGAguacgu | 1027 | ACGAguaggu |
| 1028 | CCGAguaugg | 1029 | CCGAguaagu | 1030 | CCGAguacgu | 1031 | CCGAguaggu |
| 1032 | GCGAguaugg | 1033 | GCGAguaagu | 1034 | GCGAguacgu | 1035 | GCGAguaggu |
| 1036 | UCGAguaugg | 1037 | UCGAguaagu | 1038 | UCGAguacgu | 1039 | UCGAguaggu |
| 1040 | GNGAguaugg | 1041 | GNGAguaagu | 1042 | GNGAguacgu | 1043 | GNGAguaggu |

TABLE 1-continued

Intronic REMS RNA sequence
(wherein r is adenine or guanine, and n or N is any nucleotide)

| SEQ ID NO. | Sequence | SEQ ID NO. | Sequence | SEQ ID NO. | Sequence | SEQ ID NO. | Sequence |
|---|---|---|---|---|---|---|---|
| 1044 | NGGAguaugg | 1045 | NGGAguaagu | 1046 | NGGAguacgu | 1047 | NGGAguaggu |
| 1048 | AGGAguaugg | 1049 | AGGAguaagu | 1050 | AGGAguacgu | 1051 | AGGAguaggu |
| 1052 | CGGAguaugg | 1053 | CGGAguaagu | 1054 | CGGAguacgu | 1055 | CGGAguaggu |
| 1056 | GGGAguaugg | 1057 | GGGAguaagu | 1058 | GGGAguacgu | 1059 | GGGAguaggu |
| 1060 | UGGAguaugg | 1061 | UGGAguaagu | 1062 | UGGAguacgu | 1063 | UGGAguaggu |
| 1064 | UNGAguaugg | 1065 | UNGAguaagu | 1066 | UNGAguacgu | 1067 | UNGAguaggu |
| 1068 | NUGAguaugg | 1069 | NUGAguaagu | 1070 | NUGAguacgu | 1071 | NUGAguaggu |
| 1072 | AUGAguaugg | 1073 | AUGAguaagu | 1074 | AUGAguacgu | 1075 | AUGAguaggu |
| 1076 | CUGAguaugg | 1077 | CUGAguaagu | 1078 | CUGAguacgu | 1079 | CUGAguaggu |
| 1080 | GUGAguaugg | 1081 | GUGAguaagu | 1082 | GUGAguacgu | 1083 | GUGAguaggu |
| 1084 | UUGAguaugg | 1085 | UUGAguaagu | 1086 | UUGAguacgu | 1087 | UUGAguaggu |
| 1088 | ANGAguaugn | 1089 | ANGAguanga | 1090 | ANGAguangc | 1091 | ANGAguangg |
| 1092 | NAGAguaugu | 1093 | NAGAguanga | 1094 | NAGAguangc | 1095 | NAGAguangg |
| 1096 | AAGAguaugu | 1097 | AGGAguanga | 1098 | AGGAguangc | 1099 | AAGAguangg |
| 1100 | CAGAgnaugu | 1101 | CAGAguanga | 1102 | CAGAguangc | 1103 | CAGAguangg |
| 1104 | GAGAguaugu | 1105 | GAGAguanga | 1106 | GAGAguangc | 1107 | GAGAguangg |
| 1108 | UAGAguaugu | 1109 | UAGAguanga | 1110 | UAGAguangc | 1111 | UAGAguangg |
| 1112 | CNGAguaugu | 1113 | CNGAguanga | 1114 | CNGAguangc | 1115 | CNGAguangg |
| 1116 | NCGAguaugu | 1117 | NCGAguanga | 1118 | NCGAguangc | 1119 | NCGAguangg |
| 1120 | ACGAguaugu | 1121 | ACGAguanga | 1122 | ACGAguangc | 1123 | ACGAguangg |
| 1124 | CCGAguaugu | 1125 | CCGAguanga | 1126 | CCGAguangc | 1127 | CCGAguangg |
| 1128 | GCGAguaugu | 1129 | GCGAguanga | 1130 | GCGAguangc | 1131 | GCGAguangg |
| 1132 | UCGAguaugu | 1133 | UCGAguanga | 1134 | UCGAguangc | 1135 | UCGAguangg |
| 1136 | GNGAguaugn | 1137 | GNGAguanga | 1138 | GNGAguangc | 1139 | GNGAguangg |
| 1140 | NGGAguaugu | 1141 | NGGAguanga | 1142 | NGGAguangc | 1143 | NGGAguangg |
| 1144 | AGGAguaugn | 1145 | AGGAguanga | 1146 | AGGAguangc | 1147 | AGGAguangg |
| 1148 | CGGAguaugu | 1149 | CGGAguanga | 1150 | CGGAguangc | 1151 | CGGAguangg |
| 1152 | GGGAguaugu | 1153 | GGGAguanga | 1154 | GGGAguangc | 1155 | GGGAguangg |
| 1156 | UGGAguaugu | 1157 | UGGAguanga | 1158 | UGGAguangc | 1159 | UGGAguangg |
| 1160 | UNGAguaugn | 1161 | UNGAguanga | 1162 | UNGAguangc | 1163 | UNGAguangg |
| 1164 | NUGAguaugu | 1165 | NUGAguanga | 1166 | NUGAguangc | 1167 | NUGAguangg |
| 1168 | AUGAguaugu | 1169 | AUGAguanga | 1170 | AUGAguangc | 1171 | AUGAguangg |
| 1172 | CUGAguaugu | 1173 | CUGAguanga | 1174 | CUGAguangc | 1175 | CUGAguangg |
| 1176 | GUGAguaugn | 1177 | GUGAguanga | 1178 | GUGAguangc | 1179 | GUGAguangg |
| 1180 | UUGAguaugu | 1181 | UUGAguanga | 1182 | UUGAguangc | 1183 | UUGAguangg |
| 1184 | ANGAguangu | 1185 | ANGAgugngn | 1186 | ANGAgugagn | 1187 | ANGAgugcgn |
| 1188 | NAGAguangu | 1189 | NAGAgugngn | 1190 | NAGAgugagn | 1191 | NAGAgugcgn |
| 1192 | AAGAguangu | 1193 | AAGAgugngn | 1194 | AAGAgugagn | 1195 | AAGAgugcgn |

TABLE 1-continued

Intronic REMS RNA sequence
(wherein r is adenine or guanine, and n or N is any nucleotide)

| SEQ ID NO. | Sequence | SEQ ID NO. | Sequence | SEQ ID NO. | Sequence | SEQ ID NO. | Sequence |
|---|---|---|---|---|---|---|---|
| 1196 | CAGAguangu | 1197 | CAGAgugngn | 1198 | CAGAgugagn | 1199 | CAGAgugcgn |
| 1200 | GAGAguangu | 1201 | GAGAgugngn | 1202 | GAGAgugagn | 1203 | GAGAgugcgn |
| 1204 | UAGAguangu | 1205 | UAGAgugngn | 1206 | UAGAgugagn | 1207 | UAGAgugcgn |
| 1208 | CNGAguangu | 1209 | CNGAgugngn | 1210 | CNGAgugagn | 1211 | CNGAgagcgn |
| 1212 | NCGAguangu | 1213 | NCGAgugugn | 1214 | NCGAgugagn | 1215 | NCGAgugcgn |
| 1216 | ACGAguangu | 1217 | ACGAgugngn | 1218 | ACGAgugagn | 1219 | ACGAgugcgn |
| 1220 | CCGAguangu | 1221 | CCGAgugngn | 1222 | CCGAgugagn | 1223 | CCGAgugcgn |
| 1224 | GCGAguangu | 1225 | GCGAgugngn | 1226 | GCGAgugagn | 1227 | GCGAgugcgn |
| 1228 | UCGAguangu | 1229 | UCGAgugngn | 1230 | UCGAgugagn | 1231 | UCGAgugcgn |
| 1232 | GNGAguangu | 1233 | GNGAgugngn | 1234 | GNGAgugagn | 1235 | GNGAgugcgn |
| 1236 | NGGAguangu | 1237 | NGGAgugngn | 1238 | NGGAgugagn | 1239 | NGGAgugcgn |
| 1240 | AGGAguangu | 1241 | AGGAgugngn | 1242 | AGGAgugagn | 1243 | AGGAgugcgn |
| 1244 | CGGAguangu | 1245 | CGGAgugngn | 1246 | CGGAgugagn | 1247 | CGGAgugcgn |
| 1248 | GGGAguangu | 1249 | GGGAgugngn | 1250 | GGGAgugagn | 1251 | GGGAgugcgn |
| 1252 | UGGAguangu | 1253 | UGGAgugngn | 1254 | UGGAgugagn | 1255 | UGGAgugcgn |
| 1256 | UNGAguangu | 1257 | UNGAgugngn | 1258 | UNGAgugagn | 1259 | UNGAgugcgn |
| 1260 | NUGAguangu | 1261 | NUGAgugngn | 1262 | NUGAgugagn | 1263 | NUGAgugcgn |
| 1264 | AUGAguangu | 1265 | AUGAgugngn | 1266 | AUGAgugagn | 1267 | AUGAgugcgn |
| 1268 | CUGAguangu | 1269 | CUGAgugngn | 1270 | CUGAgugagn | 1271 | CUGAgugcgn |
| 1272 | GUGAguangu | 1273 | GUGAgugngn | 1274 | GUGAgugagn | 1275 | GUGAgugcgn |
| 1276 | UUGAguangu | 1277 | UUGAgugngn | 1278 | UUGAgugagn | 1279 | UUGAgugcgn |
| 1280 | ANGAgugggn | 1281 | ANGAgugugn | 1282 | ANGAgugaga | 1283 | ANGAgugcga |
| 1284 | NAGAgugggn | 1285 | NAGAgugugn | 1286 | NAGAgugaga | 1287 | NAGAgugcga |
| 1288 | AAGAgugggn | 1289 | AAGAgugugn | 1290 | AAGAgugaga | 1291 | AAGAgugcga |
| 1292 | CAGAgugggn | 1293 | CAGAgugugn | 1294 | CAGAgugaga | 1295 | CAGAgugcga |
| 1296 | GAGAgugggn | 1297 | GAGAgugugn | 1298 | GAGAgugaga | 1299 | GAGAgugcga |
| 1300 | UAGAgugggn | 1301 | UAGAgugugn | 1302 | UAGAgugaga | 1303 | UAGAgugcga |
| 1304 | CNGAgugggn | 1305 | CNGAgugugn | 1306 | CNGAgugaga | 1307 | CNGAgugcga |
| 1308 | NCGAgugggn | 1309 | NCGAgugugn | 1310 | NCGAgugaga | 1311 | NCGAgugcga |
| 1312 | AGCAgugggn | 1313 | ACGAgugugn | 1314 | ACGAgugaga | 1315 | ACGAgugcga |
| 1316 | CCGAgugggn | 1317 | CCGAgugugn | 1318 | CCGAgugaga | 1319 | CCGAgugcga |
| 1320 | GCGAgugggn | 1321 | GCGAgugugn | 1322 | GCGAgugaga | 1323 | GCGAgugcga |
| 1324 | UCGAgugggn | 1325 | UCGAgugugn | 1326 | UCGAgugaga | 1327 | UCGAgugcga |
| 1328 | GNGAgugggn | 1329 | GNGAgugugn | 1330 | GNGAgugaga | 1331 | GNGAgugcga |
| 1332 | NGGAgugggn | 1333 | NGGAgugugn | 1334 | NGGAgugaga | 1335 | NGGAgugcga |
| 1336 | AGGAgugggn | 1337 | AGGAgugugn | 1338 | AGGAgugaga | 1339 | AGGAgugcga |
| 1340 | CGGAgugggn | 1341 | CGGAgugugn | 1342 | CGGAgugaga | 1343 | CGGAgugcga |

TABLE 1-continued

Intronic REMS RNA sequence
(wherein r is adenine or guanine, and n or N is any nucleotide)

| SEQ ID NO. | Sequence | SEQ ID NO. | Sequence | SEQ ID NO. | Sequence | SEQ ID NO. | Sequence |
|---|---|---|---|---|---|---|---|
| 1344 | GGGAgugggn | 1345 | GGGAgugugn | 1346 | GGGAgugaga | 1347 | GGGAgugcga |
| 1348 | UGGAgugggn | 1349 | UGGAgugugn | 1350 | UGGAgugaga | 1351 | UGGAgugcga |
| 1352 | UNGAgugggn | 1353 | UNGAgugugn | 1354 | UNGAgugaga | 1355 | UNGAgugcga |
| 1356 | NUGAgugggn | 1357 | NUGAgugugn | 1358 | NUGAgugaga | 1359 | NUGAgugcga |
| 1360 | AUGAgugggn | 1361 | AUGAgugugn | 1362 | AUGAgugaga | 1363 | AUGAgugcga |
| 1364 | CUGAgugggn | 1365 | CUGAgugugn | 1366 | CUGAgugaga | 1367 | CUGAgugcga |
| 1368 | GUGAgugggn | 1369 | GUGAgugugn | 1370 | GUGAgugaga | 1371 | GUGAgugcga |
| 1372 | UUGAgugggn | 1373 | UUGAgugugn | 1374 | UUGAgugaga | 1375 | UUGAgugcga |
| 1376 | ANGAguggga | 1377 | ANGAguguga | 1378 | ANGAgugagc | 1379 | ANGAgugcgc |
| 1380 | NAGAguggga | 1381 | NAGAguguga | 1382 | NAGAgugagc | 1383 | NAGAgugcgc |
| 1384 | AAGAguggga | 1385 | AAGAguguga | 1386 | AAGAgugagc | 1387 | AAGAgugcgc |
| 1388 | CAGAguggga | 1389 | CAGAguguga | 1390 | CAGAgugagc | 1391 | CAGAgugcgc |
| 1392 | GAGAguggga | 1393 | GAGAguguga | 1394 | GAGAgugagc | 1395 | GAGAgugcgc |
| 1396 | UAGAguggga | 1397 | UAGAguguga | 1398 | UAGAgugagc | 1399 | UAGAgugcgc |
| 1400 | CNGAguggga | 1401 | CNGAguguga | 1402 | CNGAgugagc | 1403 | CNGAgugcgc |
| 1404 | NCGAguggga | 1505 | NCGAguguga | 1406 | NCGAgugagc | 1407 | NCGAgugcgc |
| 1408 | ACGAguggga | 1409 | ACGAguguga | 1410 | ACGAgugagc | 1411 | ACGAgugcgc |
| 1412 | CCGAguggga | 1314 | CCGAguguga | 1414 | CCGAgugagc | 1415 | CCGAgugcgc |
| 1416 | GCGAguggga | 1417 | GCGAguguga | 1418 | GCGAgugagc | 1419 | GCGAgugcgc |
| 1420 | UCGAguggga | 1421 | UCGAguguga | 1422 | UCGAgugagc | 1423 | UCGAgugcgc |
| 1424 | GNGAguggga | 1425 | GNGAguguga | 1426 | GNGAgugagc | 1427 | GNGAgugcgc |
| 1428 | NGGAguggga | 1429 | NGGAguguga | 1430 | NGGAgugagc | 1431 | NGGAgugcgc |
| 1432 | AGGAguggga | 1433 | AGGAguguga | 1434 | AGGAgugagc | 1435 | AGGAgugcgc |
| 1436 | CGGAguggga | 1437 | CGGAguguga | 1438 | CGGAgugagc | 1439 | CGGAgugcgc |
| 1440 | GGGAguggga | 1441 | GGGAguguga | 1442 | GGGAgugagc | 1443 | GGGAgugcgc |
| 1444 | UGGAguggga | 1445 | UGGAguguga | 1446 | UGGAgugagc | 1447 | UGGAgugcgc |
| 1448 | UNGAguggga | 1449 | UNGAguguga | 1450 | UNGAgugagc | 1451 | UNGAgugcgc |
| 1452 | NUGAguggga | 1453 | NUGAguguga | 1454 | NUGAgugagc | 1455 | NUGAgugcgc |
| 1456 | AUGAguggga | 1457 | AUGAguguga | 1458 | AUGAgugagc | 1459 | AUGAgugcgc |
| 1460 | CUGAguggga | 1461 | CUGAguguga | 1462 | CUGAgugagc | 1463 | CUGAgugcgc |
| 1464 | GUGAguggga | 1465 | GUGAguguga | 1466 | GUGAgugagc | 1467 | GUGAgugcgc |
| 1468 | UUGAguggga | 1469 | UUGAguguga | 1470 | UUGAgugagc | 1471 | UUGAgugcgc |
| 1472 | ANGAgugggc | 1473 | ANGAgugugc | 1474 | ANGAgugagg | 1475 | ANGAgugcgg |
| 1476 | NAGAgugggc | 1477 | NAGAgugugc | 1478 | NAGAgugagg | 1479 | NAGAgugcgg |
| 1480 | AAGAgugagg | 1481 | CAGAgugugc | 1486 | AGGAgugagg | 1483 | AAGAgugcgg |
| 1484 | CAGAgugggc | 1485 | CAGAgugugc | 1486 | CAGAgugagg | 1487 | CAGAgugcgg |
| 1488 | GAGAgugggc | 1489 | GAGAgugugc | 1490 | GAGAgugagg | 1491 | GAGAgugcgg |
| 1492 | UAGAgugagg | 1493 | UAGAgugugc | 1494 | UAGAgugagg | 1495 | UAGAgugcgg |

TABLE 1-continued

Intronic REMS RNA sequence
(wherein r is adenine or guanine, and n or N is any nucleotide)

| SEQ ID NO. | Sequence | SEQ ID NO. | Sequence | SEQ ID NO. | Sequence | SEQ ID NO. | Sequence |
|---|---|---|---|---|---|---|---|
| 1496 | CNGAgugggc | 1497 | CNGAgugugc | 1498 | CNGAgugagg | 1499 | CNGAgugcgg |
| 1500 | NCGAgugagg | 1501 | NCGAgugugc | 1502 | NCGAgugagg | 1503 | NCGAgugcgg |
| 1504 | ACGAgugggc | 1505 | ACGAgugugc | 1506 | ACGAgugagg | 1507 | ACGAgugcgg |
| 1508 | CCGAgugggc | 1509 | CCGAgugugc | 1510 | CCGAgugagg | 1511 | CCGAgugcgg |
| 1512 | GCGAgugagg | 1513 | GCGAgugugc | 1514 | GCGAgugagg | 1515 | GCGAgugcgg |
| 1516 | UCGAgugggc | 1517 | UCGAgugugc | 1518 | UCGAgugagg | 1519 | UCGAgugcgg |
| 1520 | GNGAgugggc | 1521 | GNGAgugugc | 1522 | GNGAgugagg | 1523 | GNGAgugcgg |
| 1524 | NGGAgugagg | 1525 | NGGAgugugc | 1526 | NGGAgugagg | 1527 | NGGAgugcgg |
| 1528 | AGGAgugggc | 1529 | AGGAgugugc | 1530 | AGGAgugagg | 1531 | AGGAgugcgg |
| 1532 | CGGAgugggc | 1533 | CGGAgugugc | 1534 | CGGAgugagg | 1535 | CGGAgugcgg |
| 1536 | GGGAgugagg | 1537 | GGGAgugugc | 1538 | GGGAgugagg | 1539 | GGGAgugcgg |
| 1540 | UGGAgugggc | 1541 | UGGAgugugc | 1542 | UGGAgugagg | 1543 | UGGAgugcgg |
| 1544 | UNGAgugggc | 1545 | UNGAgugugc | 1546 | UNGAgugagg | 1547 | UNGAgugcgg |
| 1548 | NUGAgugagg | 1549 | NUGAgugugc | 1550 | NUGAgugagg | 1551 | NUGAgugcgg |
| 1552 | AUGAgugggc | 1553 | AUGAgugugc | 1554 | AUGAgugagg | 1555 | AUGAgugcgg |
| 1556 | CUGAgugagg | 1557 | CUGAgugugc | 1558 | CUGAgugagg | 1559 | CUGAgugcgg |
| 1560 | GUGAgugggc | 1561 | GUGAgugugc | 1562 | GUGAgugagg | 1563 | GUGAgugcgg |
| 1564 | UUGAgugagg | 1565 | UUGAgugugc | 1566 | UUGAgugagg | 1567 | UUGAgugcgg |
| 1568 | ANGAgugggg | 1569 | ANGAgugugg | 1570 | ANGAgugagu | 1571 | ANGAgugcgu |
| 1572 | NAGAgugggg | 1573 | NAGAgugugg | 1574 | NAGAgugagu | 1575 | NAGAgugcgu |
| 1576 | AAGAgugggg | 1577 | AAGAgugugg | 1578 | AAGAgugagu | 1579 | AAGAgugcgu |
| 1580 | CAGAgugggg | 1581 | CAGAgugugg | 1582 | CAGAgugagu | 1583 | CAGAgugcgu |
| 1584 | GAGAgugggg | 1585 | GAGAgugugg | 1586 | GAGAgugagu | 1587 | GAGAgugcgu |
| 1588 | UAGAgugggg | 1589 | UAGAgugugg | 1590 | UAGAgugagu | 1591 | UAGAgugcgu |
| 1592 | CNGAgugggg | 1593 | CNGAgugugg | 1594 | CNGAgugagu | 1595 | CNGAgugcgu |
| 1596 | NCGAgugggg | 1597 | NCGAgugugg | 1598 | NCGAgugagu | 1599 | NCGAgugcgu |
| 1600 | ACGAgugggg | 1601 | ACGAgugugg | 1602 | ACGAgugagu | 1603 | ACGAgugcgu |
| 1604 | CCGAgugggg | 1605 | CCGAgugugg | 1606 | CCGAgugagu | 1607 | CCGAgugcgu |
| 1608 | GCGAgugggg | 1609 | GCGAgugugg | 1610 | GCGAgugagu | 1611 | GCGAgugcgu |
| 1612 | UCGAgugggg | 1613 | UCGAgugugg | 1614 | UCGAgugagu | 1615 | UCGAgugcgu |
| 1616 | GNGAgugggg | 1617 | GNGAgugugg | 1618 | GNGAgugagu | 1619 | GNGAgugcgu |
| 1620 | NGGAgugggg | 1621 | NGGAgugugg | 1622 | NGGAgugagu | 1623 | NGGAgugcgu |
| 1624 | AGGAgugggg | 1625 | AGGAgugugg | 1626 | AGGAgugagu | 1627 | AGGAgugcgu |
| 1628 | CGGAgugggg | 1629 | CGGAgugugg | 1630 | CGGAgugagu | 1631 | CGGAgugcgu |
| 1632 | GGGAgugggg | 1633 | GGGAgugugg | 1634 | GGGAgugagu | 1635 | GGGAgugcgu |
| 1636 | UGGAgugggg | 1637 | UGGAgugugg | 1638 | UGGAgugagu | 1639 | UGGAgugcgu |
| 1640 | UNGAgugggg | 1641 | UNGAgugugg | 1642 | UNGAgugagu | 1643 | UNGAgugcgu |

TABLE 1-continued

Intronic REMS RNA sequence
(wherein r is adenine or guanine, and n or N is any nucleotide)

| SEQ ID NO. | Sequence | SEQ ID NO. | Sequence | SEQ ID NO. | Sequence | SEQ ID NO. | Sequence |
|---|---|---|---|---|---|---|---|
| 1644 | NUGAgugggg | 1645 | NUGAgugugg | 1646 | NUGAgugagu | 1647 | NUGAgugcgu |
| 1648 | AUGAgugggg | 1649 | AUGAgugugg | 1650 | AUGAgugagu | 1651 | AUGAgugcgu |
| 1652 | CUGAgugggg | 1653 | CUGAgugugg | 1654 | CUGAgugagu | 1655 | CUGAgugcgu |
| 1656 | GUGAgugggg | 1657 | GUGAgugugg | 1658 | GUGAgugagu | 1659 | GUGAgugcgu |
| 1660 | UUGAgugggg | 1661 | UUGAgugugg | 1662 | UUGAgugagu | 1663 | UUGAgugcgu |
| 1664 | ANGAgugggu | 1665 | ANGAgugugu | 1666 | ANGAgugnga | 1667 | ANGAgugngc |
| 1668 | NAGAgugggu | 1669 | NAGAgugugu | 1670 | NAGAgugnga | 1671 | NAGAgugngc |
| 1672 | AAGAgugggu | 1673 | AAGAgugugu | 1674 | AAGAgugnga | 1675 | AAGAgugngc |
| 1676 | CAGAgugggu | 1677 | CAGAgugugu | 1678 | CAGAgugnga | 1679 | CAGAgugngc |
| 1680 | GAGAgugggu | 1681 | GAGAgugugu | 1682 | GAGAgugnga | 1683 | GAGAgugngc |
| 1684 | UAGAgugggu | 1685 | UAGAgugugu | 1686 | UAGAgugnga | 1687 | UAGAgugngc |
| 1688 | CNGAgugggu | 1689 | CNGAgugugu | 1690 | CNGAgugnga | 1691 | CNGAgugngc |
| 1692 | NCGAgugggu | 1693 | NCGAgugugu | 1694 | NCGAgugnga | 1695 | NCGAgugngc |
| 1696 | ACGAgugggu | 1697 | ACGAgugugu | 1698 | ACGAgugnga | 1699 | ACGAgugngc |
| 1700 | CCGAgugggu | 1701 | CCGAgugugu | 1702 | CCGAgugnga | 1703 | CCGAgugngc |
| 1704 | GCGAgugggu | 1705 | GCGAgugugu | 1706 | GCGAgugnga | 1707 | GCGAgugngc |
| 1708 | UCGAgugggu | 1709 | UCGAgugugu | 1710 | UCGAgugnga | 1711 | UCGAgugngc |
| 1712 | GNGAgugggu | 1713 | GNGAgugugu | 1714 | GNGAgugnga | 1715 | GNGAgugngc |
| 1716 | NGGAgugggu | 1717 | NGGAgugugu | 1718 | NGGAgugnga | 1719 | NGGAgugngc |
| 1770 | AGGAgugggu | 1721 | AGGAgugugu | 1722 | AGGAgugnga | 1723 | AGGAgugngc |
| 1724 | CGGAgugggu | 1725 | CGGAgugugu | 1726 | CGGAgugnga | 1727 | CGGAgugngc |
| 1728 | GGGAgugggu | 1729 | GGGAgugugu | 1730 | GGGAgugnga | 1731 | GGGAgugngc |
| 1732 | UGGAgugggu | 1733 | UGGAgugugu | 1734 | UGGAgugnga | 1735 | UGGAgugngc |
| 1736 | UNGAgugggu | 1737 | UNGAgugugu | 1738 | UNGAgugnga | 1739 | UNGAgugngc |
| 1740 | NUGAgugggu | 1741 | NUGAgugugu | 1742 | NUGAgugnga | 1743 | NUGAgugngc |
| 1744 | AUGAgugggu | 1745 | AUGAgugugu | 1746 | AUGAgugnga | 1747 | AUGAgugngc |
| 1748 | CUGAgugggu | 1749 | CUGAgugugu | 1750 | CUGAgugnga | 1751 | CUGAgugngc |
| 1752 | GUGAgugggu | 1753 | GUGAgugugu | 1754 | GUGAgugnga | 1755 | GUGAgugngc |
| 1756 | UUGAgugggu | 1757 | UUGAgugugu | 1758 | UUGAgugnga | 1759 | UUGAgugngc |
| 1760 | ANGAgugugg | 1761 | GNGAgugngg | 1762 | ANGAgugngu | 1763 | GNGAgugngu |
| 1764 | NAGAgugngg | 1765 | NGGAgugngg | 1766 | NAGAgugngu | 1767 | NGGAgugngu |
| 1768 | AAGAgugngg | 1769 | AGGAgugngg | 1770 | AAGAgugngu | 1771 | AGGAgugngu |
| 1772 | CAGAgugngg | 1773 | CGGAgugngg | 1774 | CAGAgugngu | 1775 | CGGAgugngu |
| 1776 | GAGAgugngg | 1777 | GGGAgugngg | 1778 | GAGAgugngu | 1779 | GGGAgugngu |
| 1780 | UAGAgugngg | 1781 | UGGAgugngg | 1782 | UAGAgugngu | 1783 | UGGAgugngu |
| 1784 | CNGAgugngg | 1785 | UNGAgugngg | 1786 | CNGAgugngu | 1787 | UNGAgugngu |
| 1788 | NCGAgugngg | 1789 | NUGAgugngg | 1790 | NCGAgugngu | 1791 | NUGAgugngu |
| 1792 | ACGAgugngg | 1793 | AUGAgugngg | 1794 | ACGAgugngu | 1795 | AUGAgugngu |

TABLE 1-continued

Intronic REMS RNA sequence
(wherein r is adenine or guanine, and n or N is any nucleotide)

| SEQ ID NO. | Sequence | SEQ ID NO. | Sequence | SEQ ID NO. | Sequence | SEQ ID NO. | Sequence |
|---|---|---|---|---|---|---|---|
| 1796 | CCGAgugngg | 1797 | CUGAgugugg | 1798 | CCGAgugngu | 1799 | CUGAgugngu |
| 1800 | GCGAgugngg | 1801 | GUGAgugngg | 1802 | GCGAgugngu | 1803 | GUGAgngngu |
| 1804 | UCGAgugngg | 1805 | UUGAgugngg | 1806 | UCGAgugngu | 1807 | UUGAgugngu |

In one aspect, provided herein are methods for modulating the amount of one, two, three or more RNA transcripts of a gene described herein, the method comprising contacting a cell with a compound of Formula (I) or a form thereof. In another aspect, provided herein are methods for modulating the amount of one, two, three or more RNA transcripts of a gene described herein, wherein the precursor transcript transcribed from the gene comprises an intronic REMS, the method comprising contacting a cell with a compound of Formula (I) or a form thereof. In another aspect, provided herein are methods for modulating the amount of one, two, three or more RNA transcripts of a gene, disclosed in International Patent Application No. PCT/US2014/071252 (International Publication No. WO 2015/105657), wherein the precursor transcript transcribed from the gene comprises an intronic REMS, the method comprising contacting a cell with a compound of Formula (I) or a form thereof. In another aspect, provided herein are methods for modulating the amount of one, two, three or more RNA transcripts of a gene, disclosed in International Patent Application No, PCT/US2016/034864 (International Publication No. WO 2016/196386), wherein the precursor transcript transcribed from the gene comprises an intronic RENTS, the method comprising contacting a cell with a compound of Formula (I) or a form thereof. In another aspect, provided herein are methods for modulating the amount of one, two, three or more RNA transcripts of a gene, disclosed in International Patent Application No. PCT/US2017/063323 (International Publication No. WO/2018/098446), wherein the precursor transcript transcribed from the gene comprises an intronic REMS, the method comprising contacting a cell with a compound of Formula (I) or a form thereof.

In one aspect, provided herein are methods for modulating the amount of one, two, three or more RNA transcripts of a gene described herein, the method comprising contacting a cell with a compound of Formula (I) or a form thereof. In another aspect, provided herein are methods for modulating the amount of one, two, three or more RNA transcripts of a gene described herein, wherein the precursor transcript transcribed from the gene comprises an intronic REMS, the method comprising contacting a cell with a compound of Formula (I) or a form thereof. In another aspect, provided herein are methods for modulating the amount of one, two, three or more RNA transcripts of a gene described herein, wherein the precursor transcript transcribed from the gene comprises an intronic REMS, the method comprising contacting a cell with a compound of Formula (I) or a form thereof. In another aspect, provided herein are methods for modulating the amount of one, two, three or more RNA transcripts of a gene described herein, comprising contacting a cell with a compound of Formula (I) or a form thereof. In certain aspects, the cell is contacted with the compound of Formula (I) or a form thereof in a cell culture. In other aspects, the cell is contacted with the compound of Formula (I) or a form thereof in a subject (e.g., a non-human animal subject or a human subject).

In another aspect, provided herein are methods for modulating the amount of one, two, three or more RNA transcripts of a gene described herein, wherein the precursor RNA transcript transcribed from the gene comprises an intronic REMS, the methods comprising administering to a human or non-human subject a compound of Formula (I) or a form thereof, a pharmaceutical composition comprising a compound of Formula (I) or a form thereof and a pharmaceutically acceptable carrier, excipient or diluent. In one aspect, provided herein are methods for modulating the amount of one, two, three or more RNA transcripts of a gene described herein, the methods comprising administering to a human or non-human subject thereof a compound of Formula (I) or a form thereof, or a pharmaceutical composition comprising a compound of Formula (I) or a form thereof and a pharmaceutically acceptable carrier, excipient or diluent.

In another aspect, provided herein are methods for modulating the amount of one, two, three or more RNA transcripts of a gene described herein, wherein the precursor RNA transcript transcribed from the gene comprises an intronic REMS, the methods comprising administering to a human or non-human subject thereof a compound of Formula (I) or a form thereof, or a pharmaceutical composition comprising a compound of Formula (I) or a form thereof and a pharmaceutically acceptable carrier, excipient or diluent.

In another aspect, provided herein are methods for modulating the amount of one, two, three or more RNA transcripts of a gene described herein, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent.

In another aspect, provided herein are methods for modulating the amount of one, two, three or more RNA transcripts of a gene described herein, comprising administering to a human or non-human subject a compound of Formula (I) or a form thereof, or a pharmaceutical composition comprising a compound of Formula (I) or a form thereof and a pharmaceutically acceptable carrier, excipient or diluent. See the example section for additional information regarding the genes described herein. In some aspects, a compound of Formula (I) is a compound selected from a compound described herein.

In another aspect of any of the foregoing methods for modulating the amount of one, two, three or more RNA transcripts of a gene described herein, the minimally required functional intronic REMS elements comprise, in 5' to 3' order: an intronic REMS sequence, a branch point sequence and a 3' splice site sequence.

In another aspect, provided herein is a method for modulating the amount of an RNA transcript comprising a RNA nucleotide sequence, wherein the RNA nucleotide sequence comprises two exons and an intron, wherein a first exon is upstream of the intron and a second exon is downstream of the intron, wherein the RNA nucleotide sequence of the intron comprises in 5' to 3' order: a first 5' splice site, a first branch point, a first 3' splice site, an iREMS, a second branch point and a second 3' splice site, wherein the iREMS comprises an RNA sequence GAgurngn, and wherein r is adenine or guanine and n is any nucleotide, the method comprising contacting the RNA transcript with a compound described herein (for example, a compound of Formula (I) or a form thereof or another small molecule splicing modulator compound). In a specific aspect, the RNA transcript is a transcript of a gene described herein (e.g., in a table herein or the examples herein). In a specific aspect, the iREMS is non-endogenous.

In another aspect, provided herein is a method for modulating the amount of an RNA transcript comprising a RNA nucleotide sequence, wherein the RNA nucleotide sequence comprises two exons and an intron, wherein a first exon is upstream of the intron and a second exon is downstream of the intron, wherein the RNA nucleotide sequence of the intron comprises in 5' to 3' order: a branch point, a 3' splice site, and an iREMS, wherein the iREMS comprises an RNA sequence GAgurngn, and wherein r is adenine or guanine and n is any nucleotide, the method comprising contacting the RNA transcript with a compound described herein (for example, a compound of Formula (I) or a form thereof or another small molecule splicing modulator compound). In a specific aspect, the RNA transcript is a transcript of a gene described herein (e.g., in a table herein or the examples herein). In a specific aspect, the iREMS is non-endogenous.

In another aspect, provided herein is a method for modulating the amount of an RNA transcript comprising a RNA nucleotide sequence, wherein the RNA nucleotide sequence comprises two exons and an intron, and wherein the RNA nucleotide sequence comprises exonic and intronic elements illustrated in FIG. 1A, the method comprising contacting the RNA transcript with a compound described herein (for example, a compound of Formula (I) or a form thereof or another small molecule splicing modulator compound): In a specific aspect, the RNA transcript is a transcript of a gene described herein (e.g., in a table herein or the examples herein). In a specific aspect, the iREMS is non-endogenous.

In another aspect, provided herein is a method for modulating the amount of an RNA transcript comprising a RNA nucleotide sequence, wherein the RNA nucleotide sequence comprises two exons and an intron, and wherein the RNA nucleotide sequence comprises exonic and intronic elements illustrated in FIG. 1B, the method comprising contacting the RNA transcript with a compound described herein (for example, a compound of Formula (I) or a form thereof or another small molecule splicing modulator compound). In a specific aspect, the RNA transcript is a transcript of a gene described herein (e.g., in a table herein or the examples herein). In a specific aspect, the iREMS is non-endogenous.

In another aspect, provided herein is a method for modulating the amount of an RNA transcript comprising a RNA nucleotide sequence, wherein the RNA nucleotide sequence comprises three exons and two introns, and wherein the RNA nucleotide sequence comprises exonic and intronic elements illustrated in FIG. 1C, the method comprising contacting the RNA transcript with a compound described herein (for example, a compound of Formula (I) or a form thereof or another small molecule splicing modulator compound). In a specific aspect, the RNA transcript is a transcript of a gene described herein (e.g., in a table or the examples herein). In a specific aspect, the iREMS is non-endogenous.

In a specific aspect, the RNA transcript is the RNA transcript of a gene described in a table in this disclosure.

In another aspect, provided herein is a method for modulating the amount of the product of a gene (such as an RNA transcript or a protein) in a subject, wherein the gene comprises a DNA nucleotide sequence encoding two exons and an intron, wherein the nucleotide sequence encoding a first exon is upstream of the nucleotide sequence encoding the intron and the nucleotide sequence encoding a second exon is downstream of the nucleotide sequence encoding the intron, wherein the DNA nucleotide sequence encoding the intron comprises in 5' to 3' order: a nucleotide sequence encoding a first 5' splice site, a nucleotide sequence encoding a first branch point, a nucleotide sequence encoding a first 3' splice site, a nucleotide sequence encoding an iREMS, a nucleotide sequence encoding a second branch point and a nucleotide sequence encoding a second 3' splice site, wherein the nucleotide sequence encoding the iREMS comprises a DNA sequence GAgtrngn, and wherein r is adenine or guanine and n is any nucleotide, the method comprising administering a compound described herein (for example, a compound of Formula (I) or a form thereof or another small molecule splicing modulator compound) to the subject.

In another aspect, provided herein is a method for modulating the amount of the product of a gene (such as an RNA transcript or protein) in a subject, wherein the gene comprises a DNA nucleotide sequence encoding two exons and an intron, wherein the nucleotide sequence encoding a first exon is upstream of the nucleotide sequence encoding the intron and the nucleotide sequence encoding a second exon is downstream of the nucleotide sequence encoding the intron, wherein the DNA nucleotide sequence of the intron comprises in 5' to 3' order: a nucleotide sequence encoding a branch point, a nucleotide sequence encoding a 3' splice site, and a nucleotide sequence encoding an iREMS, wherein the nucleotide sequence encoding the iREMS comprises a DNA sequence GAgtrngn, and wherein r is adenine or guanine and n is any nucleotide, the method comprising administering a compound described herein (for example, a compound of Formula (I) or a form thereof or another small molecule splicing modulator compound) to the subject.

In another aspect, provided herein is a method for modulating the amount of the product of a gene (such as an RNA transcript or protein) in a subject, wherein the gene comprises a DNA nucleotide sequence encoding two exons and an intron, wherein the nucleotide sequence encoding a first exon is upstream of the nucleotide sequence encoding the intron and the nucleotide sequence encoding a second exon is downstream of the nucleotide sequence encoding the intron, wherein the DNA nucleotide sequence of the intron comprises in 5' to 3' order: a nucleotide sequence encoding an iREMS, a nucleotide sequence encoding a branch point, and a nucleotide sequence encoding a 3' splice site, wherein the nucleotide sequence encoding the iREMS comprises a DNA sequence GAgtrngn, and wherein r is adenine or guanine and n is any nucleotide, the method comprising administering a compound described herein (for example, a compound of Formula (I) or a form thereof or another small molecule splicing modulator compound) to the subject.

In another aspect, provided herein is a method for modulating the amount of the product of a gene (such as an RNA transcript or protein) in a subject, wherein the gene comprises a DNA nucleotide sequence encoding two exons and an intron, and wherein the DNA nucleotide sequence encodes exonic and intronic elements illustrated in FIG. 1A, the method comprising administering a compound described herein (for example, a compound of Formula (I) or a form thereof or another small molecule splicing modulator compound) to the subject.

In another aspect, provided herein is a method for modulating the amount of the product of a gene (such as an RNA transcript or protein) in a subject, wherein the gene comprises a DNA nucleotide sequence encoding two exons and an intron, and wherein the DNA nucleotide sequence encodes exonic and intronic elements illustrated in FIG. 1B, the method comprising administering a compound described herein (for example, a compound of Formula (I) or a form thereof or another small molecule splicing modulator compound) to the subject.

In another aspect, provided herein is a method for modulating the amount of the product of a gene (such as an RNA transcript or protein) in a subject, wherein the gene comprises a DNA nucleotide sequence encoding two exons and an intron, and wherein the DNA nucleotide sequence encodes exonic and intronic elements illustrated in FIG. 1C, the method comprising administering a compound described herein (for example, a compound of Formula or a form thereof or another small molecule splicing modulator compound) to the subject.

In a specific aspect, the gene is a gene described in a table in this disclosure.

In another aspect, provided herein are methods for preventing and/or treating a disease associated with the aberrant expression of a product of a gene (e.g., an mRNA transcript or protein), wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In one aspect, provided herein are methods for preventing and/or treating a disease associated with aberrant expression of a product of a gene (e.g., an mRNA, RNA transcript or protein) described herein, the methods comprising administering to a human or non-human subject a compound of Formula (I) or a form thereof; or a pharmaceutical composition comprising a compound of Formula (I) or a form thereof and a pharmaceutically acceptable carrier, excipient or diluent. In another aspect, provided herein are methods for preventing and/or treating a disease associated with aberrant expression of a product of a gene (e.g., an mRNA, RNA transcript or protein) described herein, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In another aspect, provided herein are methods for preventing and/or treating a disease associated with aberrant expression of a product of a gene (e.g., an mRNA, RNA transcript or protein) described herein, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In another aspect, provided herein are methods for preventing and/or treating a disease associated with aberrant expression of a product of a gene described herein (e.g., an mRNA, RNA transcript or protein), comprising administering to a human or non-human subject a compound of Formula (I) or a form thereof, or a pharmaceutical composition comprising a compound of Formula (I) or a form thereof and a pharmaceutically acceptable carrier, excipient or diluent. See the example section for additional information regarding the genes described herein. In certain aspects, a compound of Formula (I) is a compound selected from a compound described herein.

In another aspect, provided herein are methods for preventing and/or treating a disease in which a change in the level of expression of one, two, three or more RNA isoforms encoded by a gene is beneficial to the prevention and/or treatment of the disease, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In one aspect, provided herein are methods for preventing and/or treating a disease in which the modulation (e.g., increase or decrease) in the expression one, two, three or more RNA isoforms encoded by a gene described herein is beneficial to the prevention and/or treatment of the disease, the methods comprising administering to a human or non-human subject a compound of Formula (I) or a form thereof, or a pharmaceutical composition comprising a compound of Formula (I) or a form thereof and a pharmaceutically acceptable carrier, excipient or diluent.

In another aspect, provided herein are methods for preventing and/or treating a disease in which the modulation (e.g., increase or decrease) in the expression one, two, three or more RNA isoforms encoded by a gene described herein is beneficial to the prevention and/or treatment of the disease, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent.

In another aspect, provided herein are methods for preventing and/or treating a disease in which the modulation (e.g., increase or decrease) in the expression one, two, three or more RNA isoforms encoded by a gene described herein is beneficial to the prevention and/or treatment of the disease, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In another aspect, provided herein are methods for preventing and/or treating a disease in which the modulation (e.g., increase or decrease) in the expression one, two, three or more RNA isoforms encoded by a gene described herein is beneficial to the prevention and/or treatment of the disease, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In a specific aspect, one, two, three or more RNA isoforms encoded by a gene described herein are decreased following administration of a compound of Formula (I) or a form thereof and a pharmaceutically acceptable carrier, excipient or diluent. See the example section for additional information regarding the genes described herein. In certain aspects, a compound of Formula (I) is a compound selected from a compound described herein.

In another aspect, provided herein are methods for preventing and/or treating a disease in which a change in the level of expression of one, two, three or more protein isoforms encoded by a gene is beneficial to the prevention and/or treatment of the disease, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent.

In one aspect, provided herein are methods for preventing and/or treating a disease in which the modulation (e.g., increase or decrease) in the expression one, two, three or more protein isoforms encoded by a gene described herein is beneficial to the prevention and/or treatment of the disease, the methods comprising administering to a human or non-human subject a compound of Formula (I) or a form thereof, or a pharmaceutical composition comprising a compound of Formula (I) or a form thereof and a pharmaceutically acceptable carrier, excipient or diluent.

In another aspect, provided herein are methods for preventing and/or treating a disease in which the modulation (e.g., increase or decrease) in the expression one, two, three or more protein isoforms encoded by a gene described herein is beneficial to the prevention and/or treatment of the disease, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In another aspect, provided herein are methods for preventing and/or treating a disease in which the modulation (e.g., increase or decrease) in the expression one, two, three or more protein isoforms encoded by a gene described herein is beneficial to the prevention and/or treatment of the disease, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent.

In another aspect, provided herein are methods for preventing and/or treating a disease in which the modulation (e.g., increase or decrease) in the expression one, two, three or more protein isoforms encoded by a gene described herein is beneficial to the prevention and/or treatment of the disease, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In a specific aspect, one, two, three or more RNA isoforms encoded by a gene described herein are decreased following administration of a compound of Formula (I) or a form thereof and a pharmaceutically acceptable carrier, excipient or diluent. See the example section for additional information regarding the genes described herein. In certain aspects, a compound of Formula (I) is a compound selected from a compound described herein.

In another aspect, provided herein is a method for either preventing, treating or preventing and treating a disease in a subject in which the modulation (e.g., increase or decrease) in the expression one, two, three or more protein isoforms encoded by a gene is beneficial to the prevention and/or treatment of the disease, wherein the gene comprises a DNA nucleotide sequence encoding two exons and an intron, wherein the nucleotide sequence encoding a first exon is upstream of the nucleotide sequence encoding the intron and the nucleotide sequence encoding a second exon is downstream of the nucleotide sequence encoding the intron, wherein the DNA nucleotide sequence encoding the intron comprises in 5' to 3' order: a nucleotide sequence encoding a first 5' splice site, a nucleotide sequence encoding a first branch point, a nucleotide sequence encoding a first 3' splice site, a nucleotide sequence encoding an iREMS, a nucleotide sequence encoding a second branch point and a nucleotide sequence encoding a second 3' splice site, wherein the nucleotide sequence encoding the iREMS comprises a DNA sequence GAgtrngn, and wherein r is adenine or guanine and n is any nucleotide, the method comprising administering a compound described herein (for example, a compound of Formula (I) or a form thereof or another small molecule splicing modulator compound) to the subject.

In another aspect, provided herein is a method for either preventing, treating or preventing and treating a disease in a subject in which the modulation (e.g., increase or decrease) in the expression one, two, three or more protein isoforms encoded by a gene is beneficial to the prevention and/or treatment of the disease, wherein the gene comprises a DNA nucleotide sequence encoding two exons and an intron, wherein the nucleotide sequence encoding a first exon is upstream of the nucleotide sequence encoding the intron and the nucleotide sequence encoding a second exon is downstream of the nucleotide sequence encoding the intron, wherein the DNA nucleotide sequence of the intron comprises in 5' to 3' order: a nucleotide sequence encoding a branch point, a nucleotide sequence encoding a 3' splice site, and a nucleotide sequence encoding an iREMS, wherein the nucleotide sequence encoding the iREMS comprises a DNA sequence GAgtrngn, and wherein r is adenine or guanine and n is any nucleotide, the method comprising administering a compound described herein (for example, a compound of Formula (I) or a form thereof or another small molecule splicing modulator compound) to the subject.

In another aspect, provided herein is a method for either preventing, treating or preventing and treating a disease in a subject in which the modulation (e.g., increase or decrease) in the expression one, two, three or more protein isoforms encoded by a gene is beneficial to the prevention and/or treatment of the disease, wherein the gene comprises a DNA nucleotide sequence encoding two exons and an intron, and wherein the DNA nucleotide sequence encodes exonic and intronic elements illustrated in FIG. 1A, the method comprising administering a compound described herein (for example, a compound of Formula (I) or a form thereof or another small molecule splicing modulator compound) to the subject.

In another aspect, provided herein is a method for either preventing, treating or preventing and treating a disease in a subject in which the modulation (e.g., increase or decrease) in the expression one, two, three or more protein isoforms encoded by a gene is beneficial to the prevention and/or treatment of the disease, wherein the gene comprises a DNA nucleotide sequence encoding two exons and an intron, and wherein the DNA nucleotide sequence encodes exonic and intronic elements illustrated in FIG. 1B, the method comprising administering a compound described herein (for example, a compound of Formula (I) or a form thereof or another small molecule splicing modulator compound) to the subject.

In another aspect, provided herein is a method for either preventing, treating or preventing and treating a disease in a subject in which the modulation (e.g., increase or decrease) in the expression one, two, three or more protein isoforms encoded by a gene is beneficial to the prevention and/or treatment of the disease, wherein the gene comprises a DNA nucleotide sequence encoding two exons and an intron, and wherein the DNA nucleotide sequence encodes exonic and intronic elements illustrated in FIG. 1C, the method comprising administering a compound described herein (for example, a compound of Formula (I) or a form thereof or another small molecule splicing modulator compound) to the subject.

In a specific aspect, the gene is a gene described in a table in this disclosure.

In another aspect, provided herein are artificial gene constructs. In one aspect, provided herein is an artificial gene construct comprising endogenous DNA modified to introduce a non-endogenous nucleotide sequence encoding an intron comprising a 3' splice site(s) and a branch point(s) and an intronic REMS. In another aspect, provided herein is an artificial gene construct comprising DNA encoding exons and one, two or more introns, wherein a nucleotide sequence encoding an intronic REMS, functioning as a 5' splice site in the presence of a compound described herein, which may be upstream of an endogenous nucleotide sequence encoding a branch point and an endogenous nucleotide sequence encoding a 3' splice site, is modified to introduce a nucleotide sequence encoding a non-endogenous branch point and a non-endogenous 3' splice site further upstream from the endogenous intronic REMS. In another aspect, provided herein is an artificial gene construct comprising DNA encoding exons and one, two or more introns, wherein a nucleotide sequence encoding an intronic REMS 5' splice site, which may be downstream of an endogenous nucleotide sequence encoding a branch point and an endogenous nucleotide sequence encoding a 3' splice site, is modified to introduce a nucleotide sequence encoding a non-endogenous branch point and a non-endogenous 3' splice site further downstream from the endogenous intronic REMS. In another aspect, provided herein is an artificial gene construct comprising DNA encoding an intronic REMS, comprising nucleotides encoding an intronic REMS having one or more 5' splice site(s), 3' splice site(s) and branch point(s). In certain aspects, the artificial gene construct encodes a frameshift or premature stop codon or internal insertions or deletions within the open reading frame. In other aspects, the artificial gene construct encodes a mature mRNA having a functional open reading frame, producing a novel protein which may or may not be functional. In some aspects, the artificial gene construct encodes a detectable reporter protein. RNA transcripts having an altered or truncated open reading frame due to the inclusion of a frame-maintaining sequence, frameshift, premature stop codon or internal insertions or deletions within the open reading frame can be substrates for nonsense-mediated decay and thus have low abundance. Any intronic REMS-mediated alternatively spliced RNA transcripts may also have modulated stability, intracellular transport, 3' end formation efficiency and/or translation efficiency when compared to the wild type RNA transcript.

In a specific aspect, the nucleotide sequence of the intronic REMS introduced into the nucleotide sequence of the artificial gene construct comprises the sequence NNGAgtrngn (SEQ ID NO: 1808), wherein r is adenine or guanine and n or N is any nucleotide. In a specific aspect, in the context of DNA, the nucleotide sequence encoding the intronic REMS comprises a sequence selected from the group consisting of ANGAgtrngn (SEQ ID NO: 1809), CNGAgtrngn (SEQ ID NO: 1810), GNGAgtrngn (SEQ ID NO: 1811), TNGAgtrngn (SEQ ID NO: 1812), NAGAgtrngn (SEQ ID NO: 1813), NCGAgtrngn (SEQ ID NO: 1814), NGGAgtrngn (SEQ ID NO: 1815), NTGAgtrngn (SEQ ID NO: 1816), AAGAgtrngn (SEQ ID NO: 1817), ACGAgtrngn (SEQ ID NO: 1818), AGGAgtrngn (SEQ ID NO: 1819), ATGAgtrngn (SEQ ID NO: 1820), CAGAgtrngn (SEQ ID NO: 1821), CCGAgtrngn (SEQ ID NO: 1822), CGGAgtrngn (SEQ ID NO: 1823), CTGAgtrngn (SEQ ID NO: 1824), GAGAgtrngn (SEQ ID NO: 1825), GCGAgtrngn (SEQ ID NO: 1826), GGGAgtrngn (SEQ ID NO: 1827), GTGAgtrngn (SEQ ID NO: 1828), TAGAgtrngn (SEQ ID NO: 1829), TCGAgtrngn (SEQ ID NO: 1830), TGGAgtrngn (SEQ ID NO: 1831) and TTGAgtrngn (SEQ ID NO: 1832), wherein r is adenine or guanine and n or N is any nucleotide.

In a further specific aspect, in the context of DNA, the nucleotide sequence encoding the intronic REMS comprises a sequence selected from the group consisting of ANGAgtragt (SEQ ID NO: 1833), CNGAgtragt (SEQ ID NO: 1834), GNGAgtragt (SEQ ID NO: 1835), TNGAgtragt (SEQ ID NO: 1836), NAGAgtragt (SEQ ID NO: 1837), NCGAgtragt (SEQ ID NO: 1838), NGGAgtragt (SEQ ID NO: 1839), NTGAgtragt (SEQ ID NO: 1840), AAGAgtragt (SEQ ID NO: 1841), ACGAgtragt (SEQ ID NO: 1842), AGGAgtragt (SEQ ID NO: 1843), ATGAgtragt (SEQ ID NO: 1844), CAGAgtragt (SEQ ID NO: 1845), CCGAgtragt (SEQ ID NO: 1846), CGGAgtragt (SEQ ID NO: 1847), CTGAgtragt (SEQ ID NO: 1848), GAGAgtragt (SEQ ID NO: 1849), GCGAgtragt (SEQ ID NO: 1850), GGGAgtragt (SEQ ID NO: 1851), GTGAgtragt (SEQ ID NO: 1852), TAGAgtragt (SEQ ID NO: 1853), TCGAgtragt (SEQ ID NO: 1854), TGGAgtragt (SEQ ID NO: 1855) and TTGAgtragt (SEQ ID NO: 1856), wherein r is adenine or guanine and N is any nucleotide. In one or more aspects provided herein, N is adenine or guanineA or G. In various specific aspects, the nucleotide sequence encoding the intronic REMS is a nucleotide sequence encoding a non-endogenous intronic REMS, i.e., a precursor RNA transcript comprising the non-endogenous intronic REMS not naturally found in the DNA sequence of the artificial construct.

In a specific aspect, the intronic REMS referred to in a method or artificial gene construct described herein comprises, at the DNA level, a sequence presented in Table 2 (wherein r is adenine or guanine, and n or N is any nucleotide):

TABLE 2

Intronic REMS DNA sequence
(wherein r is adenine or guanine, and n or N is any nucleotide)

| SEQ ID NO. | Sequence | SEQ ID NO. | Sequence | SEQ ID NO. | Sequence | SEQ ID NO. | Sequence |
|---|---|---|---|---|---|---|---|
| 1809 | ANGAgtrngn | 1810 | CNGAgtrngn | 1811 | GNGAgtrngn | 1812 | TNGAgtrngn |
| 1813 | NAGAgtrngn | 1814 | NCGAgtrngn | 1815 | NGGAgtrngn | 1816 | NTGAgtrngn |
| 1817 | AAGAgtrngn | 1818 | ACGAgtrngn | 1819 | AGGAgtrngn | 1820 | ATGAgtrngn |
| 1821 | CAGAgtrngn | 1822 | CCGAgtrngn | 1823 | CGGAgtrngn | 1824 | CTGAgtrngn |
| 1825 | GAGAgtrngn | 1826 | GCGAgtrngn | 1827 | GGGAgtrngn | 1828 | GTGAgtrngn |
| 1829 | TAGAgtrngn | 1830 | TCGAgtrngn | 1831 | TGGAgtrngn | 1832 | TTGAgtrngn |
| 1857 | ANGAgtragn | 1858 | ANGAgtrcgn | 1859 | ANGAgtrggn | 1860 | ANGAgtrtgn |
| 1861 | NAGAgtragn | 1862 | NAGAgtrcgn | 1863 | NAGAgtrggn | 1864 | NAGAgtrtgn |
| 1865 | AAGAgtragn | 1866 | AAGAgtrcgn | 1867 | AAGAgtrggn | 1868 | AAGAgtrtgn |
| 1869 | CAGAgtragn | 1870 | CAGAgtrcgn | 1871 | CAGAgtrggn | 1872 | CAGAgtrtgn |
| 1873 | GAGAgtragn | 1874 | GAGAgtrcgn | 1875 | GAGAgtrggn | 1876 | GAGAgtrtgn |
| 1877 | TAGAgtragn | 1878 | TAGAgtrcgn | 1879 | TAGAgtrggn | 1880 | TAGAgtrtgn |
| 1881 | CNGAgtragn | 1882 | CNGAgtrcgn | 1883 | CNGAgtrggn | 1884 | CNGAgtrtgn |
| 1885 | NCGAgtragn | 1886 | NCGAgtrcgn | 1887 | NCGAgtrggn | 1888 | NCGAgtrtgn |
| 1889 | ACGAgtragn | 1890 | ACGAgtrcgn | 1891 | ACGAgtrggn | 1892 | ACGAgtrtgn |
| 1893 | CCGAgtragn | 1894 | CCGAgtrcga | 1895 | CCGAgtrggn | 1896 | CCGAgtrtgn |
| 1897 | GCGAgtragn | 1898 | GCGAgtrcgn | 1899 | GCGAgtrggn | 1900 | GCGAgtrtgn |
| 1901 | TCGAgtragn | 1902 | TCGAgtrcgn | 1903 | TCGAgtrggn | 1904 | TCGAgtrtgn |
| 1905 | GNGAgtragn | 1906 | GNGAgtrcgn | 1907 | GNGAgtrggn | 1908 | GNGAgtrtgn |
| 1909 | NGGAgtragn | 1910 | NGGAgtrcgn | 1911 | NGGAgtrggn | 1912 | NGGAgtrtgn |
| 1913 | AGGAgtragn | 1914 | AGGAgtrcgn | 1915 | AGGAgtrggn | 1916 | AGGAgtrtgn |
| 1917 | CGGAgtragn | 1918 | CGGAgtrcgn | 1919 | CGGAgtrggn | 1920 | CGGAgtrtgn |
| 1921 | GGGAgtragn | 1922 | GGGAgtrcgn | 1923 | GGGAgtrggn | 1924 | GGGAgtrtgn |
| 1925 | TGGAgtragn | 1926 | TGGAgtrcgn | 1927 | TGGAgtrggn | 1928 | TGGAgtrtgn |
| 1929 | TNGAgtragn | 1930 | TNGAgtrcgn | 1931 | TNGAgtrggn | 1932 | TNGAgtrtgn |
| 1933 | NTGAgtragn | 1934 | NTGAgtrcgn | 1935 | NTGAgtrggn | 1936 | NTGAgtrtgn |
| 1937 | ATGAgtragn | 1938 | ATGAgtrcgn | 1939 | ATGAgtrggn | 1940 | ATGAgtrtgn |
| 1941 | CTGAgtragn | 1942 | CTGAgtrcgn | 1943 | CTGAgtrggn | 1944 | CTGAgtrtgn |
| 1945 | GTGAgtragn | 1946 | GTGAgtrcgn | 1947 | GTGAgtrggn | 1948 | GTGAgtrtgn |
| 1949 | TTGAgtragn | 1950 | TTGAgtrcgn | 1951 | TTGAgtrggn | 1952 | TTGAgtrtgn |
| 1953 | ANGAgtraga | 1954 | ANGAgtrcga | 1955 | ANGAgtrgga | 1956 | ANGAgtrtga |
| 1957 | NAGAgtraga | 1958 | NAGAgtrcga | 1959 | NAGAgtrgga | 1960 | NAGAgtrtga |
| 1961 | AAGAgtraga | 1962 | AAGAgtrcga | 1963 | AAGAgtrgga | 1964 | AAGAgtrtga |
| 1965 | CAGAgtraga | 1966 | CAGAgtrcga | 1967 | CAGAgtrgga | 1968 | CAGAgtrtga |
| 1969 | GAGAgtraga | 1970 | GAGAgtrcga | 1971 | GAGAgtrgga | 1972 | GAGAgtrtga |
| 1973 | TAGAgtraga | 1974 | TAGAgtrcga | 1975 | TAGAgtrgga | 1976 | TAGAgtrtga |
| 1977 | CNGAgtraga | 1978 | CNGAgtrcga | 1979 | CNGAgtrgga | 1980 | CNGAgtrtga |
| 1981 | NCGAgtraga | 1982 | NCGAgtrcga | 1983 | NCGAgtrgga | 1984 | NCGAgtrtga |

TABLE 2-continued

Intronic REMS DNA sequence
(wherein r is adenine or guanine, and n or N is any nucleotide)

| SEQ ID NO. | Sequence | SEQ ID NO. | Sequence | SEQ ID NO. | Sequence | SEQ ID NO. | Sequence |
|---|---|---|---|---|---|---|---|
| 1985 | ACGAgtraga | 1986 | ACGAgtrcga | 1987 | ACGAgtrgga | 1988 | ACGAgtrtga |
| 1989 | CCGAgtraga | 1990 | CCGAgtrcga | 1991 | CCGAgtrgga | 1992 | CCGAgtrtga |
| 1993 | GCGAgtrnga | 1994 | GCGAgtrcga | 1995 | GCGAgtrgga | 1996 | GCGAgtrtga |
| 1997 | TCGAgtraga | 1998 | TCGAgtrcga | 1999 | TCGAgtrgga | 2000 | TCGAgtrtga |
| 2001 | GNGAgtraga | 2002 | GNGAgtrcga | 2003 | GNGAgtrgga | 2004 | GNGAgtrtga |
| 2005 | NGGAgtraga | 2006 | NGGAgtrcga | 2007 | NGGAgtrgga | 2008 | NGGAgtrtga |
| 2009 | AGGAgtraga | 2010 | AGGAgtrcga | 2011 | AGGAgtrgga | 2012 | AGGAgtrtga |
| 2013 | CGGAgtraga | 2014 | CGGAgtrcga | 2015 | CGGAgtrgga | 2016 | CGGAgtrtga |
| 2017 | GGGAgtraga | 2018 | GGGAgtrcga | 2019 | GGGAgtrgga | 2020 | GGGAgtrtga |
| 2021 | TGGAgtraga | 2022 | TGGAgtrcga | 2023 | TGGAgtrgga | 2024 | TGGAgtrtga |
| 2025 | TNGAgtraga | 2026 | TNGAgtrcga | 2027 | TNGAgtrgga | 2028 | TNGAgtrtga |
| 2029 | NTGAgtraga | 2030 | NTGAgtrcga | 2031 | NTGAgtrgga | 2032 | NTGAgtrtga |
| 2033 | ATGAgtraga | 2034 | ATGAgtrcga | 2035 | ATGAgtrgga | 2036 | ATGAgtrtga |
| 2037 | CTGAgtraga | 2038 | CTGAgtrcga | 2039 | CTGAgtrgga | 2040 | CTGAgtrtga |
| 2041 | GTGAgtraga | 2042 | GTGAgtrcga | 2043 | GTGAgtrgga | 2044 | GTGAgtrtga |
| 2045 | TTGAgtraga | 2046 | TTGAgtrcga | 2047 | TTGAgtrgga | 2048 | TTGAgtrtga |
| 2049 | ANGAgtragc | 2050 | ANGAgtrcgc | 2051 | ANGAgtrggc | 2052 | ANGAgtrtgc |
| 2053 | NAGAgtragc | 2054 | NAGAgtrcgc | 2055 | NAGAgtrggc | 2056 | NAGAgtrtgc |
| 2057 | AAGAgtragc | 2058 | AAGAgtrcgc | 2059 | AAGAgtrggc | 2060 | AAGAgtrtgc |
| 2061 | CAGAgtragc | 2062 | CAGAgtrcgc | 2063 | CAGAgtrggc | 2064 | CAGAgtrtgc |
| 2065 | GAGAgtragc | 2066 | GAGAgtrcgc | 2067 | GAGAgtrggc | 2068 | GAGAgtrtgc |
| 2069 | TAGAgtragc | 2070 | TAGAgtrcgc | 2071 | TAGAgtrggc | 2072 | TAGAgtrtgc |
| 2073 | CNGAgtragc | 2074 | CNGAgtrcgc | 2075 | CNGAgtrggc | 2076 | CNGAgtrtgc |
| 2077 | NCGAgtragc | 2078 | NCGAgtrcgc | 2079 | NCGAgtrggc | 2080 | NCGAgtrtgc |
| 2081 | ACGAgtragc | 2082 | ACGAgtrcgc | 2083 | ACGAgtrggc | 2084 | ACGAgtrtgc |
| 2085 | CCGAgtragc | 2086 | CCGAgtrcgc | 2087 | CCGAgtrggc | 2088 | CCGAgtrtgc |
| 2089 | GCGAgtrngc | 2090 | GCGAgtrcgc | 2091 | GCGAgtrggc | 2092 | GCGAgtrtgc |
| 2093 | TCGAgtragc | 2094 | TCGAgtrcgc | 2095 | TCGAgtrggc | 2096 | TCGAgtrtgc |
| 2097 | GNGAgtragc | 2098 | GNGAgtrcgc | 2099 | GNGAgtrggc | 2100 | GNGAgtrtgc |
| 2101 | NGGAgtragc | 2102 | NGGAgtrcgc | 2103 | NGGAgtrggc | 2104 | NGGAgtrtgc |
| 2105 | AGGAgtragc | 2106 | AGGAgtrcgc | 2107 | AGGAgtrggc | 2108 | AGGAgtrtgc |
| 2109 | CGGAgtragc | 2110 | CGGAgtrcgc | 2111 | CGGAgtrggc | 2112 | CGGAgtrtgc |
| 2113 | GGGAgtragc | 2114 | GGGAgtrcgc | 2115 | GGGAgtrggc | 2116 | GGGAgtrtgc |
| 2117 | TGGAgtragc | 2118 | TGGAgtrcgc | 2119 | TGGAgtrggc | 2120 | TGGAgtrtgc |
| 2121 | TNGAgtragc | 2122 | TNGAgtrcgc | 2123 | TNGAgtrggc | 2124 | TNGAgtrtgc |
| 2125 | NTGAgtragc | 2126 | NTGAgtrcgc | 2127 | NTGAgtrggc | 2128 | NTGAgtrtgc |
| 2129 | ATGAgtragc | 2130 | ATGAgtrcgc | 2131 | ATGAgtrggc | 2132 | ATGAgtrtgc |

TABLE 2-continued

Intronic REMS DNA sequence
(wherein r is adenine or guanine, and n or N is any nucleotide)

| SEQ ID NO. | Sequence | SEQ ID NO. | Sequence | SEQ ID NO. | Sequence | SEQ ID NO. | Sequence |
|---|---|---|---|---|---|---|---|
| 2133 | CTGAgtragc | 2134 | CTGAgtrcgc | 2135 | CTGAgtrggc | 2136 | CTGAgtrtgc |
| 2137 | GTGAgtragc | 2138 | GTGAgtrcgc | 2139 | GTGAgtrggc | 2140 | GTGAgtrtgc |
| 2141 | TTGAgtragc | 2142 | TTGAgtrcgc | 2143 | TTGAgtrggc | 2144 | TTGAgtrtgc |
| 2145 | ANGAgtragg | 2146 | ANGAgtrcgg | 2147 | ANGAgtrggg | 2148 | ANGAgtrtgg |
| 2149 | NAGAgtragg | 2150 | NAGAgtrcgg | 2151 | NAGAgtrggg | 2152 | NAGAgtrtgg |
| 2153 | AAGAgtragg | 2154 | AAGAgtrcgg | 2155 | AAGAgtrggg | 2156 | AAGAgtrtgg |
| 2157 | CAGAgtragg | 2158 | CAGAgtrcgg | 2159 | CAGAgtrggg | 2160 | CAGAgtrtgg |
| 2161 | GAGAgtragg | 2162 | GAGAgtrcgg | 2163 | GAGAgtrggg | 2164 | GAGAgtrtgg |
| 2165 | TAGAgtragg | 2166 | TAGAgtrcgg | 2167 | TAGAgtrggg | 2168 | TAGAgtrtgg |
| 2169 | CNGAgtragg | 2170 | CNGAgtrcgg | 2171 | CNGAgtrggg | 2172 | CNGAgtrtgg |
| 2173 | NCGAgtragg | 2174 | NCGAgtrcgg | 2175 | NCGAgtrggg | 2176 | NCGAgtrtgg |
| 2177 | ACGAgtragg | 2178 | ACGAgtrcgg | 2179 | ACGAgtrggg | 2180 | ACGAgtrtgg |
| 2181 | CCGAgtragg | 2182 | CCGAgtrcgg | 2183 | CCGAgtrggg | 2184 | CCGAgtrtgg |
| 2185 | GCGAgtragg | 2186 | GCGAgtrcgg | 2187 | GCGAgtrggg | 2188 | GCGAgtrtgg |
| 2189 | TCGAgtragg | 2190 | TCGAgtrcgg | 2191 | TCGAgtrggg | 2192 | TCGAgtrtgg |
| 2193 | GNGAgtragg | 2194 | GNGAgtrcgg | 2195 | GNGAgtrggg | 2196 | GNGAgtrtgg |
| 2197 | NGGAgtragg | 2198 | NGGAgtrcgg | 2199 | NGGAgtrggg | 2200 | NGGAgtrtgg |
| 2201 | AGGAgtragg | 2202 | AGGAgtrcgg | 2203 | AGGAgtrggg | 2204 | AGGAgtrtgg |
| 2205 | CGGAgtragg | 2206 | CGGAgtrcgg | 2207 | CGGAgtrggg | 2208 | CGGAgtrtgg |
| 2209 | GGGAgtragg | 2210 | GGGAgtrcgg | 2211 | GGGAgtrggg | 2212 | GGGAgtrtgg |
| 2213 | TGGAgtragg | 2214 | TGGAgtrcgg | 2215 | TGGAgtrggg | 2216 | TGGAgtrtgg |
| 2217 | TNGAgtragg | 2218 | TNGAgtrcgg | 2219 | TNGAgtrggg | 2220 | TNGAgtrtgg |
| 2221 | NTGAgtragg | 2222 | NTGAgtrcgg | 2223 | NTGAgtrggg | 2224 | NTGAgtrtgg |
| 2225 | ATGAgtragg | 2226 | ATGAgtrcgg | 2227 | ATGAgtrggg | 2228 | ATGAgtrtgg |
| 2229 | CTGAgtragg | 2230 | CTGAgtrcgg | 2231 | CTGAgtrggg | 2232 | CTGAgtrtgg |
| 2233 | GTGAgtragg | 2234 | GTGAgtrcgg | 2235 | GTGAgtrggg | 2236 | GTGAgtrtgg |
| 2237 | TTGAgtragg | 2238 | TTGAgtrcgg | 2239 | TTGAgtrggg | 2240 | TTGAgtrtgg |
| 1833 | ANGAgtragt | 2241 | ANGAgtrcgt | 2242 | ANGAgtrggt | 2243 | ANGAgtrtgt |
| 1837 | NAGAgtragt | 2244 | NAGAgtrcgt | 2245 | NAGAgtrggt | 2246 | NAGAgtrtgt |
| 1841 | AAGAgtragt | 2247 | AAGAgtrcgt | 2248 | AAGAgtrggt | 2249 | AAGAgtrtgt |
| 1845 | CAGAgtragt | 2250 | CAGAgtrcgt | 2251 | CAGAgtrggt | 2252 | CAGAgtrtgt |
| 1849 | GAGAgtragt | 2253 | GAGAgtrcgt | 2254 | GAGAgtrggt | 2255 | GAGAgtrtgt |
| 1853 | TAGAgtragt | 2256 | TAGAgtrcgt | 2257 | TAGAgtrggt | 2258 | TAGAgtrtgt |
| 1834 | CNGAgtragt | 2259 | CNGAgtrcgt | 2260 | CNGAgtrggt | 2261 | CNGAgtrtgt |
| 1838 | NCGAgtragt | 2262 | NCGAgtrcgt | 2263 | NCGAgtrggt | 2264 | NCGAgtrtgt |
| 1842 | ACGAgtragt | 2265 | ACGAgtrcgt | 2266 | ACGAgtrggt | 2267 | ACGAgtrtgt |
| 1846 | CCGAgtragt | 2268 | CCGAgtrcgt | 2269 | CCGAgtrggt | 2270 | CCGAgtrtgt |
| 1850 | GCGAgtTagt | 2271 | GCGAgtrcgt | 2272 | GCGAgtrggt | 2273 | GCGAgtrtgt |

TABLE 2-continued

Intronic REMS DNA sequence
(wherein r is adenine or guanine, and n or N is any nucleotide)

| SEQ ID NO. | Sequence | SEQ ID NO. | Sequence | SEQ ID NO. | Sequence | SEQ ID NO. | Sequence |
|---|---|---|---|---|---|---|---|
| 1854 | TCGAgtragt | 2274 | TCGAgtrcgt | 2275 | TCGAgtrggt | 2276 | TCGAgtrtgt |
| 1835 | GNGAgtragt | 2277 | GNGAgtrcgt | 2278 | GNGAgtrggt | 2279 | GNGAgtrtgt |
| 1839 | NGGAgtragt | 2280 | NGGAgtrcgt | 2281 | NGGAgtrggt | 2282 | NGGAgtrtgt |
| 1843 | AGGAgtragt | 2283 | AGGAgtrcgt | 2284 | AGGAgtrggt | 2285 | AGGAgtrtgt |
| 1847 | CGGAgtragt | 2286 | CGGAgtrcgt | 2287 | CGGAgtrggt | 2288 | CGGAgtrtgt |
| 1851 | GGGAgtragt | 2289 | GGGAgtrcgt | 2290 | GGGAgtrggt | 2291 | GGGAgtrtgt |
| 1855 | TGGAgtragt | 2292 | TGGAgtrcgt | 2293 | TGGAgtrggt | 2294 | TGGAgtrtgt |
| 1836 | TNGAgtragt | 2295 | TNGAgtrcgt | 2296 | TNGAgtrggt | 2297 | TNGAgtrtgt |
| 1840 | NTGAgtragt | 2298 | NTGAgtrcgt | 2299 | NTGAgtrggt | 2300 | NTGAgtrtgt |
| 1844 | ATGAgtragt | 2301 | ATGAgtrcgt | 2302 | ATGAgtrggt | 2303 | ATGAgtrtgt |
| 1848 | CTGAgtragt | 2304 | CTGAgtrcgt | 2305 | CTGAgtrggt | 2306 | CTGAgtrtgt |
| 1852 | GTGAgtragt | 2307 | GTGAgtrcgt | 2308 | GTGAgtrggt | 2309 | GTGAgtrtgt |
| 1856 | TTGAgtragt | 2310 | TTGAgtrcgt | 2311 | TTGAgtrggt | 2312 | TTGAgtrtgt |
| 2313 | ANGAgtrnga | 2314 | ANGAgtrngc | 2315 | ANGAgtrngg | 2316 | ANGAgtrngt |
| 2317 | NAGAgtraga | 2318 | NAGAgtrngc | 2319 | NAGAgtrngg | 2320 | NAGAgtrngt |
| 2321 | AAGAgtrnga | 2322 | AAGAgtrngc | 2323 | AAGAgtrngg | 2324 | AAGAgtrngt |
| 2325 | CAGAgtrnga | 2326 | CAGAgtrngc | 2327 | CAGAgtrngg | 2328 | CAGAgtrngt |
| 2329 | GAGAgtrnga | 2330 | GAGAgtrngc | 2331 | GAGAgtrngg | 2332 | GAGAgtrngt |
| 2333 | TAGAgtrnga | 2334 | TAGAgtrngc | 2335 | TAGAgtrngg | 2336 | TAGAgtrngt |
| 2337 | CNGAgtrnga | 2338 | CNGAgtrngc | 2339 | CNGAgtrngg | 2340 | CNGAgtrngt |
| 2341 | NCGAgtrnga | 2342 | NCGAgtrngc | 2343 | NCGAgtrngg | 2344 | NCGAgtrngt |
| 2345 | ACGAgtrnga | 2346 | ACGAgtrngc | 2347 | ACGAgtrngg | 2348 | ACGAgtrngt |
| 2349 | CCGAgtrnga | 2350 | CCGAgtrngc | 2351 | CCGAgtrngg | 2352 | CCGAgtrngt |
| 2353 | GCGAgtrnga | 2354 | GCGAgtrngc | 2355 | GCGAgtrngg | 2356 | GCGAgtrngt |
| 2357 | TCGAgtrnga | 2358 | TCGAgtrngc | 2359 | TCGAgtrngg | 2360 | TCGAgtragt |
| 2361 | GNGAgtrnga | 2362 | GNGAgtrngc | 2363 | GNGAgtrngg | 2364 | GNGAgtrngt |
| 2365 | NGGAgtrnga | 2366 | NGGAgtrngc | 2367 | NGGAgtrngg | 2368 | NGGAgtrngt |
| 2369 | AGGAgtrnga | 2370 | AGGAgtrngc | 2371 | AGGAgtrngg | 2372 | AGGAgtrngt |
| 2373 | CGGAgtrnga | 2374 | CGGAgtrngc | 2375 | CGGAgtrngg | 2376 | CGGAgtrngt |
| 2377 | GGGAgtrnga | 2378 | GGGAgtrngc | 2379 | GGGAgtrngg | 2380 | GGGAgtrngt |
| 2381 | TGGAgtrnga | 2382 | TGGAgtrngc | 2383 | TGGAgtrngg | 2384 | TGGAgtragt |
| 2385 | TNGAgtrnga | 2386 | TNGAgtrngc | 2387 | TNGAgtrngg | 2388 | TNGAgtrngt |
| 2389 | NTGAgtrnga | 2390 | NTGAgtrngc | 2391 | NTGAgtrngg | 2392 | NTGAgtrngt |
| 2393 | ATGAgtrnga | 2394 | ATGAgtrngc | 2395 | ATGAgtrngg | 2396 | ATGAgtragt |
| 2397 | CTGAgtrnga | 2398 | CTGAgtrngc | 2399 | CTGAgtrngg | 2400 | CTGAgtrngt |
| 2401 | GTGAgtrnga | 2402 | GTGAgtrngc | 2403 | GTGAgtrngg | 2404 | GTGAgtrngt |
| 2405 | TTGAgtraga | 2406 | TTGAgtrngc | 2407 | TTGAgtrngg | 2408 | TTGAgtrngt |

TABLE 2-continued

Intronic REMS DNA sequence
(wherein r is adenine or guanine, and n or N is any nucleotide)

| SEQ ID NO. | Sequence | SEQ ID NO. | Sequence | SEQ ID NO. | Sequence | SEQ ID NO. | Sequence |
|---|---|---|---|---|---|---|---|
| 2409 | ANGAgtangn | 2410 | ANaNgtaagn | 2411 | ANGAgtacgn | 2412 | ANGAgtaggn |
| 2413 | NAGAgtangn | 2414 | NAGAgtaagn | 2415 | NAGAgtacgn | 2416 | NAGAgtaggn |
| 2417 | AAGAgtangn | 2418 | AAGAgtaagn | 2419 | AAGAgtacgn | 2420 | AAGAgtaggn |
| 2421 | CAGAgtangn | 2422 | CAGAgtaagn | 2423 | CAGAgtacgn | 2424 | CAGAgtaggn |
| 2425 | GAGAgtangn | 2426 | GAGAgtaagn | 2427 | GAGAgtacgn | 2428 | GAGAgtaggn |
| 2429 | TAGAtaangn | 2430 | TAGAgtaagn | 2431 | TAGAgtacgn | 2432 | TAGAgtaggn |
| 2433 | CNGAgtangn | 2434 | CNGAgtaagn | 2435 | CNGAgtacgn | 2436 | CNGAgtaggn |
| 2437 | NCGAgtangn | 2438 | NCGAgtaagn | 2439 | NCGAgtacgn | 2440 | NCGAgtaggn |
| 2441 | ACGAgtangn | 2442 | ACGAgtaagn | 2443 | ACGAgtacgn | 2444 | ACGAgtaggn |
| 2445 | CCGAgtangn | 2446 | CCGAgtaagn | 2447 | CCGAgtacgn | 2448 | CCGAgtaggn |
| 2449 | GCGAgtangn | 2450 | GCGAgtaagn | 2451 | GCGAgtacgn | 2452 | GCGAgtaggn |
| 2453 | TCGAgtangn | 2454 | TCGAgtaagn | 2455 | TCGAgtacgn | 2456 | TCGAgtaggn |
| 2457 | GNGAgtangn | 2458 | GNGAgtaagn | 2459 | GNGAgtacgn | 2460 | GNGAgtaggn |
| 2461 | NGGAgtangn | 2462 | NGGAgtaagn | 2463 | NGGAgtacgn | 2464 | NGGAgtaggn |
| 2465 | AGGAgtangn | 2466 | AGGAgtaagn | 2467 | AGGAgtacgn | 2468 | AGGAgtaggn |
| 2469 | CGGAgtangn | 2470 | CGGAgtaagn | 2471 | CGGAgtacgn | 2472 | CGGAgtaggn |
| 2473 | GGGAgtangn | 2474 | GGGAgtaagn | 2475 | GGGAgtacgn | 2476 | GGGAgtaggn |
| 2477 | TGGAgtangn | 2478 | TGGAgtaagn | 2479 | TGGAgtacgn | 2480 | TGGAgtaggn |
| 2481 | TNGAgtangn | 2482 | TNGAgtaagn | 2483 | TNGAgtacgn | 2484 | TNGAgtaggn |
| 2485 | NTGAgtangn | 2486 | NTGAgtaagn | 2487 | NTGAgtacgn | 2488 | NTGAgtaggn |
| 2489 | ATGAgtangn | 2490 | ATGAgtaagn | 2491 | ATGAgtacgn | 2492 | ATGAgtaggn |
| 2493 | CTGAgtangn | 2494 | CTGAgtaagn | 2495 | CTGAgtacgn | 2496 | CTGAgtaggn |
| 2497 | GTGAgtangn | 2498 | GTGAgtaagn | 2499 | GTGAgtacgn | 2500 | GTGAgtaggn |
| 2501 | TTGAgtangn | 2502 | TTGAgtaagn | 2503 | TTGAgtacgn | 2504 | TTGAgtaggn |
| 2505 | ANGAgtatgn | 2506 | ANGAgtaaga | 2507 | ANGAgtacga | 2508 | ANGAgtagga |
| 2509 | NAGAgtatgn | 2510 | NAGAgtaaga | 2511 | NAGAgtacga | 2512 | NAGAgtagga |
| 2513 | AAGAgtatgn | 2514 | AAGAgtaaga | 2515 | AAGAgtacga | 2516 | AAGAgtagga |
| 2517 | CAGAgtatgn | 2518 | CAGAgtaaga | 2519 | CAGAgtacga | 2520 | CAGAgtagga |
| 2521 | GAGAgtatgn | 2522 | GAGAgtaaga | 2523 | GAGAgtacga | 2524 | GAGAgtagga |
| 2525 | TAGAgtatgn | 2526 | TAGAgtaaga | 2527 | TAGAgtacga | 2528 | TAGAgtagga |
| 2529 | CNGAgtatgn | 2530 | CNGAgtaaga | 2531 | CNGAgtacga | 2532 | CNGAgtagga |
| 2533 | NCGAgtatgn | 2534 | NCGAgtaaga | 2535 | NCGAgtacga | 2536 | NCGAgtagga |
| 2537 | ACGAgtatgn | 2538 | ACGAgtaaga | 2539 | ACGAgtacga | 2540 | ACGAgtagga |
| 2541 | CCGAgtatgn | 2542 | CCGAgtaaga | 2543 | CCGAgtacga | 2544 | CCGAgtagga |
| 2545 | GCGAgtatgn | 2546 | GCGAgtaaga | 2547 | GCGAgtacga | 2548 | GCGAgtagga |
| 2549 | TCGAgtatgn | 2550 | TCGAgtaaga | 2551 | TCGAgtacga | 2552 | TCGAgtagga |
| 2553 | GNGAgtatgn | 2554 | GNGAgtaaga | 2555 | GNGAgtacga | 2556 | GNGAgtagga |
| 2557 | NGGAgtatgn | 2558 | NGGAgtaaga | 2559 | NGGAgtacga | 2560 | NGGAgtagga |

TABLE 2-continued

Intronic REMS DNA sequence
(wherein r is adenine or guanine, and n or N is any nucleotide)

| SEQ ID NO. | Sequence | SEQ ID NO. | Sequence | SEQ ID NO. | Sequence | SEQ ID NO. | Sequence |
|---|---|---|---|---|---|---|---|
| 2561 | AGGAgtatgn | 2562 | AGGAgtaaga | 2563 | AGGAgtacga | 2564 | AGGAgtagga |
| 2565 | CGGAgtatgn | 2566 | CGGAgtaaga | 2567 | CGGAgtacga | 2568 | CGGAgtagga |
| 2569 | GGGAgtatgn | 2570 | GGGAgtaaga | 2571 | GGGAgtacga | 2572 | GGGAgtagga |
| 2573 | TGGAgtatgn | 2574 | TGGAgtaaga | 2575 | TGGAgtacga | 2576 | TGGAgtagga |
| 2577 | TNGAgtatgn | 2578 | TNGAgtaaga | 2579 | TNGAgtacga | 2580 | TNGAgtagga |
| 2581 | NTGAgtatgn | 2582 | NTGAgtaaga | 2583 | NTGAgtacga | 2584 | NTGAgtagga |
| 2585 | ATGAgtatgn | 2586 | ATGAgtaaga | 2587 | ATGAgtacga | 2588 | ATGAgtagga |
| 2589 | CTGAgtatgn | 2590 | CTGAgtaaga | 2591 | CTGAgtacga | 2592 | CTGAgtagga |
| 2593 | GTGAgtatgn | 2594 | GTGAgtaaga | 2595 | CTTGAtacga | 2596 | GTGAgtagga |
| 2597 | TTGAgtatgn | 2598 | TTGAgtaaga | 2599 | TTGAgtacga | 2600 | TTGAgtagga |
| 2601 | ANGAgtatga | 2602 | ANGAgtaagc | 2603 | ANGAgtacgc | 2604 | ANGAgtaggc |
| 2605 | NAGAgtatga | 2606 | NAGAgtaagc | 2607 | NAGAgtacgc | 2608 | NAGAgtaggc |
| 2609 | AAGAgtatga | 2610 | AAGAgtaagc | 2611 | AAGAgtacgc | 2612 | AAGAgtaggc |
| 2613 | CAGAgtatga | 2614 | CAGAgtaagc | 2615 | CAGAgtacgc | 2616 | CAGAgtaggc |
| 2617 | GAGAgtatga | 2618 | GAGAgtaagc | 2619 | GAGAgtacgc | 2620 | GAGAgtaggc |
| 2621 | TAGAgtatga | 2622 | TAGAgtaagc | 2623 | TAGAgtacgc | 2624 | TAGAgtaggc |
| 2625 | CNGAgtatga | 2626 | CNGAgtaagc | 2627 | CNGAgtacgc | 2628 | CNGAgtaggc |
| 2629 | NCGAgtatga | 2630 | NCGAgtaagc | 2631 | NCGAgtacgc | 2632 | NCGAgtaggc |
| 2633 | ACGAgtatga | 2634 | ACGAgtaagc | 2635 | ACGAgtacgc | 2636 | ACGAgtaggc |
| 2637 | CCGAgtatga | 2638 | CCGAgtaagc | 2639 | CCGAgtacgc | 2640 | CCGAgtaggc |
| 2641 | GCGAgtatga | 2642 | GCGAgtaagc | 2643 | GCGAgtacgc | 2644 | GCGAgtaggc |
| 2645 | TCGAgtatga | 2646 | TCGAgtaagc | 2647 | TCGAgtacgc | 2648 | TCGAgtaggc |
| 2649 | GNGAgtatga | 2650 | GNGAgtaagc | 2651 | GNGAgtacgc | 2652 | GNGAgtaggc |
| 2653 | NGGAgtatga | 2654 | NGGAgtaagc | 2655 | NGGAgtacgc | 2656 | NGGAgtaggc |
| 2657 | AGGAgtatga | 2658 | AGGAgtaagc | 2659 | AGGAgtacgc | 2660 | AGGAgtaggc |
| 2661 | CGGAgtatga | 2662 | CGGAgtaagc | 2663 | CGGAgtacgc | 2664 | CGGAgtaggc |
| 2665 | GGGAgtatga | 2666 | GGGAgtaagc | 2667 | GGGAgtacgc | 2668 | GGGAgtaggc |
| 2669 | TGGAgtatga | 2670 | TGGAgtaagc | 2671 | TGGAgtacgc | 2672 | TGGAgtaggc |
| 2673 | TNGAgtatga | 2674 | TNGAgtaagc | 2675 | TNGAgtacgc | 2676 | TNGAgtaggc |
| 2677 | NTGAgtatga | 2678 | NTGAgtaagc | 2679 | NTGAgtacgc | 2680 | NTGAgtaggc |
| 2681 | ATGAgtatga | 2682 | ATGAgtaagc | 2683 | ATGAgtacgc | 2684 | ATGAgtaggc |
| 2685 | CTGAgtatga | 2686 | CTGAgtaagc | 2687 | CTGAgtacgc | 2688 | CTGAgtaggc |
| 2689 | GTGAgtatga | 2690 | GTGAgtaagc | 2691 | GTGAgtacgc | 2692 | GTGAgtaggc |
| 2693 | TTGAgtatga | 2694 | TTGAgtaagc | 2695 | TTGAgtacgc | 2696 | TTGAgtaggc |
| 2697 | ANGAgtatgc | 2698 | ANGAgtaagg | 2699 | ANGAgtacgg | 2700 | ANGAgtaggg |
| 2701 | NAGAgtatgc | 2702 | NAGAgtaagg | 2703 | NAGAgtacgg | 2704 | NAGAgtaggg |
| 2705 | AAGAgtatgc | 2706 | AAGAgtaagg | 2707 | AAGAgtacgg | 2708 | AAGAgtaggg |

TABLE 2-continued

Intronic REMS DNA sequence
(wherein r is adenine or guanine, and n or N is any nucleotide)

| SEQ ID NO. | Sequence | SEQ ID NO. | Sequence | SEQ ID NO. | Sequence | SEQ ID NO. | Sequence |
|---|---|---|---|---|---|---|---|
| 2709 | CAGAgtatgc | 2710 | CAGAgtaagg | 2711 | CAGAgtacgg | 2712 | CAGAgtaggg |
| 2713 | GAGAgtatgc | 2714 | GAGAgtaagg | 2715 | GAGAgtacgg | 2716 | GAGAgtaggg |
| 2717 | TAGAgtatgc | 2718 | TAGAgtaagg | 2719 | TAGAgtacgg | 2720 | TAGAgtaggg |
| 2721 | CNGAgtatgc | 2722 | CNGAgtaagg | 2723 | CNGAgtacgg | 2724 | CNGAgtaggg |
| 2725 | NCGAgtatgc | 2726 | NCGAgtaagg | 2727 | NCGAgtacgg | 2728 | NCGAgtaggg |
| 2729 | ACGAgtatgc | 2730 | ACGAgtaagg | 2731 | ACGAgtacgg | 2732 | ACGAgtaggg |
| 2733 | CCGAgtatgc | 2734 | CCGAgtaagg | 2735 | CCGAgtacgg | 2736 | CCGAgtaggg |
| 2737 | GCGAgtatgc | 2738 | GCGAgtaagg | 2739 | GCGAgtacgg | 2740 | GCGAgtaggg |
| 2741 | TCGAgtatgc | 2742 | TCGAgtaagg | 2743 | TCGAgtacgg | 2744 | TCGAgtaggg |
| 2745 | GNGAgtatgc | 2746 | GNGAgtaagg | 2747 | GNGAgtacgg | 2748 | GNGAgtaggg |
| 2749 | NGGAgtatgc | 2750 | NGGAgtaagg | 2751 | NGGAgtacgg | 2752 | NGGAgtaggg |
| 7753 | AGGAgtatgc | 2754 | AGGAgtaagg | 2755 | AGGAgtacgg | 2756 | AGGAgtaggg |
| 2757 | CGGAgtatgc | 2758 | CGGAgtaagg | 2759 | CGGAgtacgg | 2760 | CGGAgtaggg |
| 2761 | GGGAgtatgc | 2762 | GGGAgtaagg | 2763 | GGGAgtacgg | 2764 | GGGAgtaggg |
| 7765 | TGGAgtatgc | 2766 | TGGAgtaagg | 2767 | TGGAgtacgg | 2768 | TGGAgtaggg |
| 2769 | TNGAgtatgc | 2770 | TNGAgtaagg | 2771 | TNGAgtacgg | 2772 | TNGAgtaggg |
| 2773 | NTGAgtatgc | 2774 | NTGAgtaagg | 2775 | NTGAgtacgg | 2776 | NTGAgtaggg |
| 2777 | ATGAgtatgc | 2778 | ATGAgtaagg | 2779 | ATGAgtacgg | 2780 | ATGAgtaggg |
| 2781 | CTGAgtatgc | 2782 | CTGAgtaagg | 2783 | CTGAgtacgg | 2784 | CTGAgtaggg |
| 2785 | GTGAgtatgc | 2786 | GTGAgtaagg | 2787 | GTGAgtacgg | 2788 | GTGAgtaggg |
| 2789 | TTGAgtatgc | 2790 | TTGAgtaagg | 2791 | TTGAgtacgg | 2792 | TTGAgtaggg |
| 2793 | ANGAgtatgg | 2794 | ANGAgtaagt | 2795 | ANGAgtacgt | 2796 | ANGAgtaggt |
| 2797 | NAGAgtatgg | 2798 | NAGAgtaagt | 2799 | NAGAgtacgt | 2800 | NAGAgtaggt |
| 2801 | AAGAgtatgg | 2802 | AAGAgtaagt | 2803 | AAGAgtacgt | 2804 | AAGAgtaggt |
| 2805 | CAGAgtatgg | 2806 | CAGAgtaagt | 2807 | CAGAgtacgt | 2808 | CAGAgtaggt |
| 2809 | GAGAgtatgg | 2810 | GAGAgtaagt | 2811 | GAGAgtacgt | 2812 | GAGAgtaggt |
| 2813 | TAGAgtatgg | 2814 | TAGAgtaagt | 2815 | TAGAgtacgt | 2816 | TAGAgtaggt |
| 2817 | CNGAgtatgg | 2818 | CNGAgtaagt | 2819 | CNGAgtacgt | 2820 | CNGAgtaggt |
| 2821 | NCGAgtatgg | 2822 | NCGAgtaagt | 2823 | NCGAgtacgt | 2824 | NCGAgtaggt |
| 2825 | ACGAgtatgg | 2826 | ACGAgtaagt | 2827 | ACGAgtacgt | 2828 | ACGAgtaggt |
| 2829 | CCGAgtatgg | 2830 | CCGAgtaagt | 2831 | CCGAgtacgt | 2832 | CCGAgtaggt |
| 2833 | GCGAgtatgg | 2834 | GCGAgtaagt | 2835 | GCGAgtacgt | 2836 | GCGAgtaggt |
| 2837 | TCGAgtatgg | 2838 | TCGAgtaagt | 2839 | TCGAgtacgt | 2840 | TCGAgtaggt |
| 2841 | GNGAgtatgg | 2842 | GNGAgtaagt | 2843 | GNGAgtacgt | 2844 | GNGAgtaggt |
| 2845 | NGGAgtatgg | 2846 | NGGAgtaagt | 2847 | NGGAgtacgt | 2848 | NGGAgtaggt |
| 2849 | AGGAgtatgg | 2850 | AGGAgtaagt | 2851 | AGGAgtacgt | 2852 | AGGAgtaggt |
| 2853 | CGGAgtatgg | 2854 | CGGAgtaagt | 2855 | CGGAgtacgt | 2856 | CGGAgtaggt |
| 2857 | GGGAgtatgg | 2858 | GGGAgtaagt | 2859 | GGGAgtacgt | 2860 | GGGAgtaggt |

TABLE 2-continued

Intronic REMS DNA sequence
(wherein r is adenine or guanine, and n or N is any nucleotide)

| SEQ ID NO. | Sequence | SEQ ID NO. | Sequence | SEQ ID NO. | Sequence | SEQ ID NO. | Sequence |
|---|---|---|---|---|---|---|---|
| 2861 | TGGAgtatgg | 2862 | TGGAgtaagt | 2863 | TGGAgtacgt | 2864 | TGGAgtaggt |
| 2865 | TNGAgtatgg | 2866 | TNGAgtaagt | 2867 | TNGAgtacgt | 2868 | TNGAgtaggt |
| 2869 | NTGAgtatgg | 2870 | NTGAgtaagt | 2871 | NTGAgtacgt | 2872 | NTGAgtaggt |
| 2873 | ATGAgtatgg | 2874 | ATGAgtaagt | 2875 | ATGAgtacgt | 2876 | ATGAgtaggt |
| 2877 | CTGAgtatgg | 2878 | CTGAgtaagt | 2879 | CTGAgtacgt | 2880 | CTGAgtaggt |
| 2881 | GTGAgtatgg | 2882 | GTGAgtaagt | 2883 | GTGAgtacgt | 2884 | GTGAgtaggt |
| 2885 | TTGAgtatgg | 2886 | TTGAgtaagt | 2887 | TTGAgtacgt | 2888 | TTGAgtaggt |
| 2889 | ANGAgtatgt | 2890 | ANGAgtanga | 2891 | ANGAgtangc | 2892 | ANGAgtangg |
| 2893 | NAGAgtatgt | 2894 | NAGAgtanga | 2895 | NAGAgtangc | 2896 | NAGAgtangg |
| 2897 | AAGAgtatgt | 2898 | AAGAgtanga | 2899 | AAGAgtangc | 2900 | AAGAgtangg |
| 2901 | CAGAgtatgt | 2902 | CAGAgtanga | 2903 | CAGAgtangc | 2904 | CAGAgtangg |
| 2905 | GAGAgtatgt | 2906 | GAGAgtanga | 2907 | GAGAgtangc | 2908 | GAGAgtangg |
| 2909 | TAGAgtatgt | 2910 | TAGAgtanga | 2911 | TAGAgtangc | 2912 | TAGAgtangg |
| 2913 | CNGAgtatgt | 2914 | CNGAgtanga | 2915 | CNGAgtangc | 2916 | CNGAgtangg |
| 2917 | NCGAgtatgt | 2918 | NCGAgtanga | 2919 | NCGAgtangc | 2920 | NCGAgtangg |
| 2921 | ACGAgtatgt | 2922 | ACGAgtanga | 2923 | ACGAgtangc | 2924 | ACGAgtangg |
| 2925 | CCGAgtatgt | 2926 | CCGAgtanga | 2927 | CCGAgtangc | 2928 | CCGAgtangg |
| 2929 | GCGAgtatgt | 2930 | GCGAgtanga | 2931 | GCGAgtangc | 2932 | GCGAgtangg |
| 2933 | TCGAgtatgt | 2934 | TCGAgtanga | 2935 | TCGAgtangc | 2936 | TCGAgtangg |
| 2937 | GNGAgtatgt | 2938 | GNGAgtanga | 2939 | GNGAgtangc | 2940 | GNGAgtangg |
| 2941 | NGGAgtatgt | 2942 | NGGAgtanga | 2943 | NGGAgtangc | 2944 | NGGAgtangg |
| 2945 | AGGAgtatgt | 2946 | AGGAgtanga | 2947 | AGGAgtangc | 2948 | AGGAgtangg |
| 2949 | CGGAgtatgt | 2950 | CGGAgtanga | 2951 | CGGAgtangc | 2952 | CGGAgtangg |
| 2953 | GGGAgtatgt | 2954 | GGGAgtanga | 2955 | GGGAgtangc | 2956 | GGGAgtangg |
| 2957 | TGGAgtatgt | 2958 | TGGAgtanga | 2959 | TGGAgtangc | 2960 | TGGAgtangg |
| 2961 | TNGAgtatgt | 2962 | TNGAgtanga | 2963 | TNGAgtangc | 2964 | TNGAgtangg |
| 2965 | NTGAgtatgt | 2966 | NTGAgtanga | 2967 | NTGAgtangc | 2968 | NTGAgtangg |
| 2969 | ATGAgtatgt | 2970 | ATGAgtanga | 2971 | ATGAgtangc | 2972 | ATGAgtangg |
| 2973 | CTGAgtatgt | 2974 | CTGAgtanga | 2975 | CTGAgtangc | 2976 | CTGAgtangg |
| 2977 | GTGAgtatgt | 2978 | GTGAgtanga | 2979 | GTGAgtangc | 2980 | GTGAgtangg |
| 2981 | TTGAgtatgt | 2982 | TTGAgtanga | 2983 | TTGAgtangc | 2984 | TTGAgtangg |
| 2985 | ANGAgtangt | 2986 | ANGAgtgngn | 2987 | ANGAgtgagn | 2988 | ANGAgtgcgn |
| 2989 | NAGAgtangt | 2990 | NAGAgtgngn | 2991 | NAGAgtgagn | 2992 | NAGAgtgcgn |
| 2993 | AAGAgtangt | 2994 | AAGAgtgngn | 2995 | AAGAgtgagn | 2996 | AAGAgtgcgn |
| 2997 | CAGAgtangt | 2998 | CAGAgtgngn | 2999 | CAGAgtgagn | 3000 | CAGAgtgcgn |
| 3001 | GAGAgtangt | 3002 | GAGAgtgngn | 3003 | GAGAgtgagn | 3004 | GAGAgtgcgn |
| 3005 | TAGAgtangt | 3006 | TAGAgtgngn | 3007 | TAGAgtgagn | 3008 | TAGAgtgcgn |

TABLE 2-continued

Intronic REMS DNA sequence
(wherein r is adenine or guanine, and n or N is any nucleotide)

| SEQ ID NO. | Sequence | SEQ ID NO. | Sequence | SEQ ID NO. | Sequence | SEQ ID NO. | Sequence |
|---|---|---|---|---|---|---|---|
| 3009 | CNGAgtangt | 3010 | CNGAgtgngn | 3011 | CNGAgtgagn | 3012 | CNGAgtgcgn |
| 3013 | NCGAgtangt | 3014 | NCGAgtgngn | 3015 | NCGAgtgagn | 3016 | NCGAgtgcgn |
| 3017 | ACGAgtangt | 3018 | ACGAgtgngn | 3019 | ACGAgtgagn | 3020 | ACGAgtgcgn |
| 3021 | CCGAgtangt | 3022 | CCGAgtgngn | 3023 | CCGAgtgagn | 3024 | CCGAgtgcgn |
| 3025 | GCGAgtangt | 3026 | GCGAgtgngn | 3027 | GCGAgtgagn | 3028 | GCGAgtgcgn |
| 3029 | TCGAgtangt | 3030 | TCGAgtgngn | 3031 | TCGAgtgagn | 3032 | TCGAgtgcgn |
| 3033 | GNGAgtangt | 3034 | GNGAgtgngn | 3035 | GNGAgtgagn | 3036 | GNGAgtgcgn |
| 3037 | NGGAgtangt | 3038 | NGGAgtgngn | 3039 | NGGAgtgagn | 3040 | NGGAgtgcgn |
| 3041 | AGGAgtangt | 3042 | AGGAgtgngn | 3043 | AGGAgtgagn | 3044 | AGGAgtgcgn |
| 3045 | CGGAgtangt | 3046 | CGGAgtgngn | 3047 | CGGAgtgagn | 3048 | CGGAgtgcgn |
| 3049 | GGGAgtangt | 3050 | GGGAgtgngn | 3051 | GGGAgtgagn | 3052 | GGGAgtgcgn |
| 3053 | TGGAgtangt | 3054 | TGGAgtgngn | 3055 | TGGAgtgagn | 3056 | TGGAgtgcgn |
| 3057 | TNGAgtangt | 3058 | TNGAgtgngn | 3059 | TNGAgtgagn | 3060 | TNGAgtgcgn |
| 3061 | NTGAgtangt | 3062 | NTGAgtgngn | 3063 | NTGAgtgagn | 3064 | NTGAgtgcgn |
| 3065 | ATGAgtangt | 3066 | ATGAgtgngn | 3067 | ATGAgtgagn | 3068 | ATGAgtgcgn |
| 3069 | CTGAgtangt | 3070 | CTGAgtgngn | 3071 | CTGAgtgagn | 3072 | CTGAgtgcgn |
| 3073 | GTGAgtangt | 3074 | GTGAgtgngn | 3075 | GTGAgtgagn | 3076 | GTGAgtgcgn |
| 3077 | TTGAgtangt | 3078 | TTGAgtgngn | 3079 | TTUAgtgagn | 3080 | TTGAgtgcgn |
| 3081 | ANGAgtgggn | 3082 | ANGAgtgtgn | 3083 | ANGAgtgaga | 3084 | ANGAgtgcga |
| 3085 | NAGAgtgggn | 3086 | NAGAgtgtgn | 3087 | NAGAgtgaga | 3088 | NAGAgtgcga |
| 3089 | AAGAgtgggn | 3090 | AAGAgtgtgn | 3091 | AAGAgtgaga | 3092 | AAGAgtgcga |
| 3093 | CAGAgtgggn | 3094 | CAGAgtgtgn | 3095 | CAGAgtgaga | 3096 | CAGAgtgcga |
| 3097 | GAGAgtgggn | 3098 | GAGAgtgtgn | 3099 | GAGAgtgaga | 3100 | GAGAgtgcga |
| 3101 | TAGAgtgggn | 3102 | TAGAgtgtgn | 3103 | TAGAgtgaga | 3104 | TAGAgtgcga |
| 3105 | CNGAgtgggn | 3106 | CNGAgtgtgn | 3107 | CNGAgtgaga | 3108 | CNGAgtgcga |
| 3109 | NCGAgtgggn | 3110 | NCGAgtgtgn | 3111 | NCGAgtgaga | 3112 | NCGAgtgcga |
| 3113 | ACGAgtgggn | 3114 | ACGAgtgtgn | 3115 | ACGAgtgaga | 3116 | ACGAgtgcga |
| 3117 | CCGAgtgggn | 3118 | CCGAgtgtgn | 3119 | CCGAgtgaga | 3120 | CCGAgtgcga |
| 3121 | GCGAgtgggn | 3122 | GCGAgtgtgn | 3123 | GCGAgtgaga | 3124 | GCGAgtgcga |
| 3125 | TCGAgtgggn | 3126 | TCGAgtgtgn | 3127 | TCGAgtgaga | 3128 | TCGAgtgcga |
| 3129 | GNGAgtgggn | 3130 | GNGAgtgtgn | 3131 | GNGAgtgaga | 3132 | GNGAgtgcga |
| 3133 | NGGAgtgggn | 3134 | NGGAgtgtgn | 3135 | NGGAgtgaga | 3136 | NGGAgtgcga |
| 3137 | AGGAgtgggn | 3138 | AGGAgtgtgn | 3139 | AGGAgtgaga | 3140 | AGGAgtgcga |
| 3141 | CGGAgtgggn | 3142 | CGGAgtgtgn | 3143 | CGGAgtgaga | 3144 | CGGAgtgcga |
| 3145 | GGGAgtgggn | 3146 | GGGAgtgtgn | 3147 | GGGAgtgaga | 3148 | GGGAgtgcga |
| 3149 | TGGAgtgggn | 3150 | TGGAgtgtgn | 3151 | TGGAgtgaga | 3152 | TGGAgtgcga |
| 3153 | TNGAgtgggn | 3154 | TNGAgtgtgn | 3155 | TNGAgtgaga | 3156 | TNGAgtgcga |
| 3157 | NTGAgtgggn | 3158 | NTGAgtgtgn | 3159 | NTGAgtgaga | 3160 | NTGAgtgcga |

TABLE 2-continued

Intronic REMS DNA sequence
(wherein r is adenine or guanine, and n or N is any nucleotide)

| SEQ ID NO. | Sequence | SEQ ID NO. | Sequence | SEQ ID NO. | Sequence | SEQ ID NO. | Sequence |
|---|---|---|---|---|---|---|---|
| 3161 | ATGAgtgggn | 3162 | ATGAgtgtga | 3163 | ATGAgtgaga | 3164 | ATGAgtgcga |
| 3165 | CTGAgtgggn | 3166 | CTGAgtgtgn | 3167 | CTGAgtgaga | 3168 | CTGAgtgcga |
| 3169 | GTGAgtgggn | 3170 | GTGAgtgtgn | 3171 | GTGAgtgaga | 3172 | GTGAgtgcga |
| 3173 | TTGAgtgggn | 3174 | TTGAgtgtgn | 3175 | TTGAgtgaga | 3176 | TTGAgtgcga |
| 3177 | ANGAgtggga | 3178 | ANGAgtgtga | 3179 | ANGAgtgagc | 3180 | ANGAgtgcgc |
| 3181 | NAGAgtggga | 3182 | NAGAgtgtga | 3183 | NAGAgtgagc | 3184 | NAGAgtgcgc |
| 3185 | AAGAgtggga | 3186 | AAGAgtgtga | 3187 | AAGAgtgagc | 3188 | AAGAgtgcgc |
| 3189 | CAGAgtggga | 3190 | CAGAgtgtga | 3191 | CAGAgtgagc | 3192 | CAGAgtgcgc |
| 3193 | GAGAgtggga | 3194 | GAGAgtgtga | 3195 | GAGAgtgagc | 3196 | GAGAgtgcgc |
| 3197 | TAGAgtggga | 3198 | TAGAgtgtga | 3199 | TAGAgtgagc | 3200 | TAGAgtgcgc |
| 3201 | CNGAgtggga | 3202 | CNGAgtgtga | 3203 | CNGAgtgagc | 3204 | CNGAgtgcgc |
| 3705 | NCGAgtggga | 3206 | NCGAgtgtga | 3207 | NCGAgtgagc | 3208 | NCGAgtgcgc |
| 3209 | ACGAgtggga | 3210 | ACGAgtgtga | 3211 | ACGAgtgagc | 3212 | ACGAgtgcgc |
| 3213 | CCGAgtggga | 3214 | CCGAgtgtga | 3215 | CCGAgtgagc | 3216 | CCGAgtgcgc |
| 3217 | GCGAgtggga | 3218 | GCGAgtgtga | 3219 | GCGAgtgagc | 3220 | GCGAgtgcgc |
| 3221 | TCGAgtggga | 3222 | TCGAgtgtga | 3223 | TCGAgtgagc | 3224 | TCGAgtgcgc |
| 3225 | GNGAgtggga | 3226 | GNGAgtgtga | 3227 | GNGAgtgagc | 3228 | GNGAgtgcgc |
| 3229 | NGGAgtggga | 3230 | NGGAgtgtga | 3231 | NGGAgtgagc | 3232 | NGGAgtgcgc |
| 3233 | AGGAgtggga | 3234 | AGGAgtgtga | 3235 | AGGAgtgagc | 3236 | AGGAgtgcgc |
| 3237 | CGGAgtggga | 3238 | CGGAgtgtga | 3239 | CGGAgtgagc | 3240 | CGGAgtgcgc |
| 3241 | GGGAgtggga | 3242 | GGGAgtgtga | 3243 | GGGAgtgagc | 3244 | GGGAgtgcgc |
| 3245 | TGGAgtggga | 3246 | TGGAgtgtga | 3247 | TGGAgtgagc | 3248 | TGGAgtgcgc |
| 3249 | TNGAgtggga | 3250 | TNGAgtgtga | 3251 | TNGAgtgagc | 3252 | TNGAgtgcgc |
| 3253 | NTGAgtggga | 3254 | NTGAgtgtga | 3255 | NTGAgtgagc | 3256 | NTGAgtgcgc |
| 3257 | ATGAgtggga | 3258 | ATGAgtgtga | 3259 | ATGAgtgagc | 3260 | ATGAgtgcgc |
| 3261 | CTGAgtggga | 3262 | CTGAgtgtga | 3263 | CTGAgtgagc | 3264 | CTGAgtgcgc |
| 3265 | GTGAgtggga | 3266 | GTGAgtgtga | 3267 | GTGAgtgagc | 3268 | GTGAgtgcgc |
| 3269 | TTGAgtggga | 3270 | TTGAgtgtga | 3271 | TTGAgtgagc | 3272 | TTGAgtgcgc |
| 3273 | ANGAgtgggc | 3274 | ANGAgtgtgc | 3275 | ANGAgtgagg | 3276 | ANGAgtgcgg |
| 3277 | NAGAgtgggc | 3278 | NAGAgtgtgc | 3279 | NAGAgtgagg | 3280 | NAGAgtgcgg |
| 3281 | AAGAgtgggc | 3282 | AAGAgtgtgc | 3283 | AAGAgtgagg | 3284 | AAGAgtgcgg |
| 3285 | CAGAgtgggc | 3286 | CAGAgtgtgc | 3287 | CAGAgtgagg | 3288 | CAGAgtgcgg |
| 3289 | GAGAgtgggc | 3290 | GAGAgtgtgc | 3291 | GAGAgtgagg | 3292 | GAGAgtgcgg |
| 3293 | TAGAgtgggc | 3294 | TAGAgtgtgc | 3295 | TAGAgtgagg | 3296 | TAGAgtgcgg |
| 3297 | CNGAgtgggc | 3298 | CNGAgtgtgc | 3299 | CNGAgtgagg | 3300 | CNGAgtgcgg |
| 3301 | NCGAgtgggc | 3302 | NCGAgtgtgc | 3303 | NCGAgtgagg | 3304 | NCGAgtgcgg |
| 3305 | ACGAgtgggc | 3306 | ACGAgtgtgc | 3307 | ACGAgtgagg | 3308 | ACGAgtgcgg |

TABLE 2-continued

Intronic REMS DNA sequence
(wherein r is adenine or guanine, and n or N is any nucleotide)

| SEQ ID NO. | Sequence | SEQ ID NO. | Sequence | SEQ ID NO. | Sequence | SEQ ID NO. | Sequence |
|---|---|---|---|---|---|---|---|
| 3309 | CCGAgtgggc | 3310 | CCGAgtgtgc | 3311 | CCGAgtgagg | 3312 | CCGAgtgcgg |
| 3313 | GCGAgtgggc | 3314 | GCGAgtgtgc | 3315 | GCGAgtgagg | 3316 | GCGAgtgcgg |
| 3317 | TCGAgtgggc | 3318 | TCGAgtgtgc | 3319 | TCGAgtgagg | 3320 | TCGAgtgcgg |
| 3321 | GNGAgtgggc | 3322 | GNGAgtgtgc | 3323 | GNGAgtgagg | 3324 | GNGAgtgcgg |
| 3325 | NGGAgtgggc | 3326 | NGGAgtgtgc | 3327 | NGGAgtgagg | 3328 | NGGAgtgcgg |
| 3329 | AGGAgtgggc | 3330 | AGGAgtgtgc | 3331 | AGGAgtgagg | 3332 | AGGAgtgcgg |
| 3333 | CGGAgtgggc | 3334 | CGGAgtgtgc | 3335 | CGGAgtgagg | 3336 | CGGAgtgcgg |
| 3337 | GGGAgtgggc | 3338 | GGGAgtgtgc | 3339 | GGGAgtgagg | 3340 | GGGAgtgcgg |
| 3341 | TGGAgtgggc | 3342 | TGGAgtgtgc | 3343 | TGGAgtgagg | 3344 | TGGAgtgcgg |
| 3345 | TNGAgtgggc | 3346 | TNGAgtgtgc | 3347 | TNGAgtgagg | 3348 | TNGAgtgcgg |
| 3349 | NTGAgtgggc | 3350 | NTGAgtgtgc | 3351 | NTGAgtgagg | 3352 | NTGAgtgcgg |
| 3353 | ATGAgtgggc | 3354 | ATGAgtgtgc | 3355 | ATGAgtgagg | 3356 | ATGAgtgcgg |
| 3357 | CTGAgtgggc | 3358 | CTGAgtgtgc | 3359 | CTGAgtgagg | 3360 | CTGAgtgcgg |
| 3361 | GTGAgtgggc | 3362 | GTGAgtgtgc | 3363 | GTGAgtgagg | 3364 | GTGAgtgcgg |
| 3365 | TTGAgtgggc | 3366 | TTGAgtgtgc | 3367 | TTGAgtgagg | 3368 | TTGAgtgcgg |
| 3369 | ANGAgtgggg | 3370 | ANGAgtgtgg | 3371 | ANGAgtgagt | 3372 | ANGAgtgcgt |
| 3373 | NAGAgtgggg | 3374 | NAGAgtgtgg | 3375 | NAGAgtgagt | 3376 | NAGAgtgcgt |
| 3377 | AAGAgtgggg | 3378 | AAGAgtgtgg | 3379 | AAGAgtgagt | 3380 | AAGAgtgcgt |
| 3381 | CAGAgtgggg | 3382 | CAGAgtgtgg | 3383 | CAGAgtgagt | 3384 | CAGAgtgcgt |
| 3385 | GAGAgtgggg | 3386 | GAGAgtgtgg | 3387 | GAGAgtgagt | 3388 | GAGAgtgcgt |
| 3389 | TAGAgtgggg | 3390 | TAGAgtgtgg | 3391 | TAGAgtgagt | 3392 | TAGAgtgcgt |
| 3393 | CNGAgtgggg | 3394 | CNGAgtgtgg | 3395 | CNGAgtgagt | 3396 | CNGAgtgcgt |
| 3397 | NCGAgtgggg | 3398 | NCGAgtgtgg | 3399 | NCGAgtgagt | 3400 | NCGAgtgcgt |
| 3401 | ACGAgtgggg | 3402 | ACGAgtgtgg | 3403 | ACGAgtgagt | 3404 | ACGAgtgcgt |
| 3405 | CCGAgtgggg | 3406 | CCGAgtgtgg | 3407 | CCGAgtgagt | 3408 | CCGAgtgcgt |
| 3409 | GCGAgtgggg | 3410 | GCGAgtgtgg | 3411 | GCGAgtgagt | 3412 | GCGAgtgcgt |
| 3413 | TCGAgtgggg | 3414 | TCGAgtgtgg | 3415 | TCGAgtgagt | 3416 | TCGAgtgcgt |
| 3417 | GNGAgtgggg | 3418 | GNGAgtgtgg | 3419 | GNGAgtgagt | 3420 | GNGAgtgcgt |
| 3421 | NGGAgtgggg | 3422 | NGGAgtgtgg | 3423 | NGGAgtgagt | 3424 | NGGAgtgcgt |
| 3425 | AGGAgtgggg | 3426 | AGGAgtgtgg | 3427 | AGGAgtgagt | 3428 | AGGAgtgcgt |
| 3429 | CGGAgtgggg | 3430 | CGGAgtgtgg | 3431 | CGGAgtgagt | 3432 | CGGAgtgcgt |
| 3433 | GGGAgtgggg | 3434 | GGGAgtgtgg | 3435 | GGGAgtgagt | 3436 | GGGAgtgcgt |
| 3437 | TGGAgtgggg | 3438 | TGGAgtgtgg | 3439 | TGGAgtgagt | 3440 | TGGAgtgcgt |
| 3441 | TNGAgtgggg | 3442 | TNGAgtgtgg | 3443 | TNGAgtgagt | 3444 | TNGAgtgcgt |
| 3445 | NTGAgtgggg | 3446 | NTGAgtgtgg | 3447 | NTGAgtgagt | 3448 | NTGAgtgcgt |
| 3449 | ATGAgtgggg | 3450 | ATGAgtgtgg | 3451 | ATGAgtgagt | 3452 | ATGAgtgcgt |
| 3453 | CTGAgtgggg | 3454 | CTGAgtgtgg | 3455 | CTGAgtgagt | 3456 | CTGAgtgcgt |
| 3457 | GTGAgtgggg | 3458 | GTGAgtgtgg | 3459 | GTGAgtgagt | 3460 | GTGAgtgcgt |

TABLE 2-continued

Intronic REMS DNA sequence
(wherein r is adenine or guanine, and n or N is any nucleotide)

| SEQ ID NO. | Sequence | SEQ ID NO. | Sequence | SEQ ID NO. | Sequence | SEQ ID NO. | Sequence |
|---|---|---|---|---|---|---|---|
| 3461 | TTGAgtgggg | 3462 | TTGAgtgtgg | 3463 | TTGAgtgagt | 3464 | TTGAgtgcgt |
| 3465 | ANGAgtgggt | 3466 | ANGAgtgtgt | 3467 | ANGAgtgaga | 3468 | ANGAgtgngc |
| 3469 | NAGAgtgggt | 3470 | NAGAgtgtgt | 3471 | NAGAgtgaga | 3472 | NAGAgtgngc |
| 3473 | AAGAgtgggt | 3474 | AAGAgtgtgt | 3475 | AAGAgtgaga | 3476 | AAGAgtgngc |
| 3477 | CAGAgtgggt | 3478 | CAGAgtgtgt | 3479 | CAGAgtgnga | 3480 | CAGAgtgngc |
| 3481 | GAGAgtgggt | 3482 | GAGAgtgtgt | 3483 | GAGAgtgaga | 3484 | GAGAgtgngc |
| 3485 | TAGAgtgggt | 3486 | TAGAgtgtgt | 3487 | TAGAgtgnga | 3488 | TAGAgtgngc |
| 3489 | CNGAgtgggt | 3490 | CNGAgtgtgt | 3491 | CNGAgtgnga | 3492 | CNGAgtgngc |
| 3493 | NCGAgtgggt | 3494 | NCGAgtgtgt | 3495 | NCGAgtgnga | 3496 | NCGAgtgngc |
| 3497 | ACGAgtgggt | 3498 | ACGAgtgtgt | 3499 | ACGAgtgaga | 3500 | ACGAgtgngc |
| 3501 | CCGAgtgggt | 3502 | CCGAgtgtgt | 3503 | CCGAgtgaga | 3504 | CCGAgtgngc |
| 3505 | GCGAgtgggt | 3506 | GCGAgtgtgt | 3507 | GCGAgtgnga | 3508 | GCGAgtgngc |
| 3509 | TCGAgtgggt | 3510 | TCGAgtgtgt | 3511 | TCGAgtgaga | 3512 | TCGAgtgngc |
| 3513 | GNGAgtgggt | 3514 | GNGAgtgtgt | 3515 | GNGAgtgnga | 3516 | GNGAgtgngc |
| 3517 | NGGAgtgggt | 3518 | NGGAgtgtgt | 3519 | NGGAgtgaga | 3520 | NGGAgtgngc |
| 3521 | AGGAgtgggt | 3522 | AGGAgtgtgt | 3523 | AGGAgtgnga | 3524 | AGGAgtgngc |
| 3525 | CGGAgtgggt | 3526 | CGGAgtgtgt | 3527 | CGGAgtgnga | 3528 | CGGAgtgngc |
| 3529 | GGGAgtgggt | 3530 | GGGAgtgtgt | 3531 | GGGAgtgnga | 3532 | GGGAgtgngc |
| 3533 | TGGAgtgggt | 3534 | TGGAgtgtgt | 3535 | TGGAgtgaga | 3536 | TGGAgtgngc |
| 3537 | TNGAgtgggt | 3538 | TNGAgtgtgt | 3539 | TNGAgtgnga | 3540 | TNGAgtgngc |
| 3541 | NTGAgtgggt | 3542 | NTGAgtgtgt | 3543 | NTGAgtgnga | 3544 | NTGAgtgngc |
| 3545 | ATGAgtgggt | 3546 | ATGAgtgtgt | 3547 | ATGAgtgaga | 3548 | ATGAgtgngc |
| 3549 | CTGAgtgggt | 3550 | CTGAgtgtgt | 3551 | CTGAgtgaga | 3552 | CTGAgtgngc |
| 3553 | GTGAgtgggt | 3554 | GTGAgtgtgt | 3555 | GTGAgtgnga | 3556 | GTGAgtgngc |
| 3557 | TTGAgtgggt | 3558 | TTGAgtgtgt | 3559 | TTGAgtgnga | 3560 | TTGAgtgngc |
| 3561 | ANGAgtgngg | 3562 | GNGAgtgagg | 3563 | ANGAgtgagt | 3564 | GNGAgtgngt |
| 3565 | NAGAgtgngg | 3566 | NGGAgtgagg | 3567 | NAGAgtgagt | 3568 | NGGAgtgngt |
| 3569 | AAGAgtgngg | 3570 | AGGAgtgagg | 3571 | AAGAgtgagt | 3572 | AGGAgtgngt |
| 3573 | CAGAgtgngg | 3574 | CGGAgtgagg | 3575 | CAGAgtgagt | 3576 | CGGAgtgngt |
| 3577 | GAGAgtgngg | 3578 | GGGAgtgagg | 3579 | GAGAgtgagt | 3580 | GGGAgtgngt |
| 3581 | TAGAgtgngg | 3582 | TGGAgtgagg | 3583 | TAGAgtgagt | 3584 | TGGAgtgngt |
| 3585 | CNGAgtgngg | 3586 | TNGAgtgagg | 3587 | CNGAgtgagt | 3588 | TNGAgtgngt |
| 3589 | NCGAgtgngg | 3590 | NTGAgtgngg | 3591 | NCGAgtgagt | 3592 | NTGAgtgngt |
| 3593 | ACGAgtgngg | 3594 | ATGAgtgngg | 3595 | ACGAgtgagt | 3596 | ATGAgtgngt |
| 3597 | CCGAgtgngg | 3598 | CTGAgtgagg | 3599 | CCGAgtgagt | 3600 | CTGAgtgngt |
| 3601 | GCGAgtgngg | 3602 | GTGAgtgngg | 3603 | GCGAgtgngt | 3604 | GTGAgtgngt |
| 3605 | TCGAgtgngg | 3606 | TTGAgtgagg | 3607 | TCGAgtgngt | 3608 | TTGAgtgngt |

In certain aspects, provided herein is a vector comprising the artificial gene construct described herein. In some aspects; provided herein is a cell comprising an artificial gene construct described herein or a vector comprising an artificial gene construct described herein.

In another aspect, provided herein is a method of modulating the amount and modifying the type of a protein produced by a cell containing an artificial gene construct described herein. In one aspect, provided herein is a method of modulating the amount and modifying the type of a protein produced by a cell containing an artificial gene construct described herein, the method comprising contacting the cell with a compound of Formula (I) or a form thereof. In certain aspects, the artificial gene construct encodes a therapeutic protein. In certain aspects, the artificial gene construct encodes a non-functional protein. In some aspects producing a therapeutic protein, the artificial gene construct may also encode a detectable reporter protein. In some aspects producing a non-functional protein, the artificial gene construct may also encode a detectable reporter protein.

In another aspect, provided herein is a method of modulating the amount of a protein produced by a subject, wherein the subject is or was administered an artificial gene construct described herein. In one aspect, provided herein is method of regulating the amount of a protein produced by a subject, the method comprising: (a) administering an artificial gene construct or a vector comprising the artificial gene construct described herein to the subject; and (b) administering a compound of Formula (I) or a form thereof to the subject. In another aspect, provided herein is a method of regulating the amount of a protein produced by a subject, the method comprising administering a compound of Formula (I) or a form thereof to a subject carrying a gene containing a nucleotide sequence encoding an intronic REMS. In another aspect, provided herein is a method of regulating the amount of a protein produced by a subject, the method comprising administering a compound of Formula (I) to the subject; wherein the subject was previously administered an artificial gene construct described herein. In certain aspects, the artificial gene construct may encode a therapeutic or a non-functional protein. In some aspects, the artificial gene construct encodes a detectable reporter protein. In certain aspects, the subject is a non-human. In specific aspects, the subject is a human.

In one aspect, provided herein is a method for modifying RNA splicing in order to modulate the amount of an RNA transcript produced from precursor RNA comprising a RNA nucleotide sequence in 5' to 3' order: a branch point, a 3' splice site and an endogenous or non-endogenous intronic recognition element for splicing modifier (REMS), wherein the intronic REMS comprises an RNA sequence GAgurngn, wherein r is adenine or guanine (A or G, respectively) and n is any nucleotide, the method comprising contacting the precursor RNA with a compound of Formula (I) or a form thereof, wherein the compound of Formula (I) is:

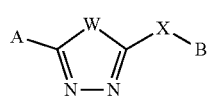

(I)

or a form thereof, wherein
W is CH=CH or S;

X is $CH_2$, $CH(C_{1-4}alkyl)$, $C(C_{1-4}alkyl)_2$, CH=CH, O, $NR_5$, or a bond;

A is aryl, heteroaryl, heterocyclyl, or $C_{9-10}$cycloalkyl,
wherein aryl is selected from phenyl and naphthyl, each optionally substituted with 1, 2, 3, or 4 substituents each selected from
wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from $R_1$,
wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from $R_2$, and
wherein $C_{9-10}$cycloalkyl is a saturated or partially unsaturated bicyclic ring system optionally substituted with 1, 2, 3, 4, or 5 substituents each selected from $R_2$;

B is heterocyclyl,
wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from $R_4$;

$R_1$ is halogen, hydroxyl, cyano, $C_{1-4}$alkyl, halo-$C_{1-4}$alkyl, amino, $C_{1-4}$alkyl-amino, $(C_{1-4}alkyl)_2$-amino, amino-$C_{1-4}$alkyl, $C_{1-4}$alkyl-amino-$C_{1-4}$alkyl, $(C_{1-4}alkyl)_2$-amino-$C_{1-4}$alkyl, amino-carbonyl, $C_{1-4}$alkyl-amino-carbonyl, $(C_{1-4}alkyl)_2$-amino-carbonyl, $C_{1-4}$alkyl-amino-carbonyl-$C_{1-4}$alkyl, $(C_{1-4}alkyl)_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $(C_{1-4}alkyl)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, heterocyclyl-$C_{1-4}$alkoxy, phenyl, or phenyl-$C_{1-4}$alkoxy,
wherein heteroaryl is a saturated monocyclic or bicyclic ring system having 1, 2, or 3 heteroatom ring members selected from N, O, and S,
wherein heterocyclyl is a saturated or partially unsaturated monocyclic or bicyclic ring system having 1, 2, or 3 heteroatom ring members selected from N, O, and S, and
wherein each instance of phenyl, heteroaryl or heterocyclyl is optionally substituted with 1, or 2 substituents each selected from $R_3$;

$R_2$ is halogen, hydroxyl, cyano, oxo, hydroxyl-imino, $C_{1-4}$alkyl, halo-$C_{1-4}$alkyl, amino, $C_{1-4}$alkyl-amino, $(C_{1-4}alkyl)_2$-amino, amino-$C_{1-4}$alkyl, $C_{1-4}$alkyl-amino-$C_{1-4}$alkyl, $(C_{1-4}alkyl)_2$-amino-$C_{1-4}$alkyl, amino-carbonyl, hydroxyl-$C_{1-4}$alkyl, $C_{1-4}$alkoxy, $C_{1-4}$alkoxy-carbonyl, $C_{2-4}$alkenyl, $C_{3-7}$cycloalkyl, or heterocyclyl-$C_{1-4}$alkyl,
wherein heterocyclyl is a saturated or partially unsaturated monocyclic or bicyclic ring system having 1, 2, or 3 heteroatom ring members selected from N, O, and S, and
wherein each instance of heterocyclyl is optionally substituted with 1, or 2 substituents each selected from $R_3$;

R$_3$ is halogen, hydroxyl, nitro, oxo, hydroxyl-imino, C$_{1-4}$alkyl, halo-C$_{1-4}$alkyl, amino, C$_{1-4}$alkyl-amino, (C$_{1-4}$alkyl)$_2$-amino, amino-C$_{1-4}$alkyl, C$_{1-4}$alkyl-amino-C$_{1-4}$alkyl (C$_{1-4}$alkyl)$_2$-amino-C$_{1-4}$alkyl, amino-carbonyl, C$_{1-4}$alkyl-amino-carbonyl, (C$_{1-4}$alkyl)$_2$-amino-carbonyl, C$_{1-4}$alkyl-amino-carbonyl-C$_{1-4}$alkyl, (C$_{1-4}$alkyl)$_2$-amino-carbonyl-C$_{1-4}$alkyl, C$_{1-4}$alkyl-carbonyl-amino, C$_{1-4}$alkyl-carbonyl-amino-C$_{1-4}$alkyl, hydroxyl-C$_{1-4}$alkyl, C$_{1-4}$alkyl-carbonyl, C$_{1-4}$alkoxy, halo-C$_{1-4}$alkoxy, amino-C$_{1-4}$alkoxy, hydroxyl-C$_{1-4}$alkoxy, C$_{1-4}$alkyl-C$_{1-4}$alkoxy, C$_{1-4}$alkyl-amino-C$_{1-4}$alkoxy, (C$_{1-4}$alkyl)$_2$-amino-C$_{1-4}$alkoxy, C$_{1-4}$alkyl-carbonyl-amino-C$_{1-4}$alkoxy, C$_{1-4}$alkoxy-C$_{1-4}$alkoxy, C$_{1-4}$alkoxy-carbonyl, C$_{1-4}$alkoxy-carbonyl-amino, C$_{1-4}$alkoxy-carbonyl-amino-C$_{1-4}$alkoxy, C$_{2-4}$alkenyl, C$_{2-4}$alkenyl-amino-carbonyl, C$_{3-7}$cycloalkyl, C$_{3-7}$cycloalkyl-C$_{1-4}$alkoxy C$_{3-7}$cycloalkenyl, heteroaryl, heteroaryl-C$_{1-4}$alkyl, heteroaryl-C$_{1-4}$alkyl-amino, heteroaryl-C$_{1-4}$alkyl-amino-carbonyl, heteroaryl-C$_{1-4}$alkyl-carbonyl-amino, heteroaryl-C$_{1-4}$alkyl-amino-carbonyl-C$_{1-4}$alkyl, heteroaryl-C$_{1-4}$alkyl-carbonyl-amino-C$_{1-4}$alkyl, heterocyclyl, heterocyclyl-C$_{1-4}$alkyl, phenyl, or phenyl-C$_{1-4}$alkoxy, R$_4$ is independently selected from halogen, C$_{1-4}$alkyl, hydroxyl-C$_{1-4}$alkyl, amino, C$_{1-4}$alkyl-amino, (C$_{1-4}$alkyl)$_2$-amino or hydroxyl-C$_{1-4}$alkyl-amino; and R$_5$ is hydrogen, C$_{1-4}$alkyl, or hydroxyl-C$_{1-4}$alkyl, wherein a form of the compound is selected from the group consisting of a prodrug, salt, hydrate, solvate, clathrate, isotopologue, racemate enantiomer diastereomer, stereoisomer, polymorph and tautomer form thereof.

In another aspect, provided herein is a method for modifying RNA splicing in order to modulate the amount of an RNA transcript produced from precursor RNA comprising a RNA nucleotide sequence in 5' to 3' order: a branch point, a 3' splice site and an endogenous or non-endogenous intronic recognition element for splicing modifier (REMS), wherein the intronic IRIS comprises an RNA sequence GAgurngn, wherein r is adenine or guanine and n is any nucleotide, the method comprising contacting the precursor RNA with a compound of Formula (I) or a form thereof, wherein the compound of Formula (I) is selected from a compound of Formula (Ia) and Formula (Ib):

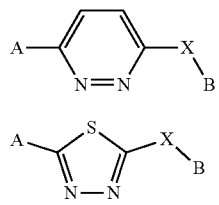

or a form thereof, wherein

X is CH$_2$, CH(C$_{1-4}$alkyl), C(C$_{1-4}$alkyl)$_2$, CH=CH, O, NR$_5$, or a bond;

A is aryl, heteroaryl, heterocyclyl, or C$_{9-10}$cycloalkyl, wherein aryl is selected from phenyl and naphthyl, each optionally substituted with 1, 2, 3, or 4 substituents each selected from R$_1$, wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from R$_1$, wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from R$_2$, and wherein C$_{9-10}$cycloalkyl is a saturated or partially unsaturated bicyclic ring system optionally substituted with 1, 2, 3, 4, or 5 substituents each selected from R$_2$;

B is heterocyclyl, wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from R$_4$;

R$_1$ is halogen, hydroxyl, cyano, C$_{1-4}$alkyl, halo-C$_{1-4}$alkyl, amino, C$_{1-4}$alkyl-amino, (C$_{1-4}$alkyl)$_2$-amino, amino-C$_{1-4}$alkyl, C$_{1-4}$alkyl-amino-C$_{1-4}$alkyl, (C$_{1-4}$alkyl)$_2$-amino-C$_{1-4}$alkyl, amino-carbonyl, C$_{1-4}$alkyl-amino-carbonyl, C$_{1-4}$alkyl-amino-carbonyl-C$_{1-4}$alkyl, C$_{1-4}$alkyl-carbonyl-amino, C$_{1-4}$alkyl-carbonyl-amino-C$_{1-4}$alkyl, hydroxyl-C$_{1-4}$alkyl, C$_{1-4}$alkyl-carbonyl, C$_{1-4}$alkoxy, halo-C$_{1-4}$alkoxy, amino-C$_{1-4}$alkoxy, hydroxyl-C$_{1-4}$alkoxy, C$_{1-4}$alkyl-C$_{1-4}$alkoxy, C$_{1-4}$alkyl-amino-C$_{1-4}$alkoxy, (C$_{1-4}$alkyl)$_2$-amino-C$_{1-4}$alkoxy, C$_{1-4}$alkyl-carbonyl-amino-C$_{1-4}$alkoxy, C$_{1-4}$alkoxy-C$_{1-4}$alkoxy, C$_{1-4}$alkoxy-carbonyl, C$_{1-4}$alkoxy-carbonyl-amino, C$_{1-4}$alkoxy-carbonyl-amino-C$_{1-4}$alkoxy, C$_{2-4}$alkenyl, C$_{2-4}$alkenyl-amino-carbonyl, C$_{3-7}$cycloalkyl, C$_{3-7}$cycloalkyl-C$_{1-4}$alkoxy, C$_{3-7}$cycloalkenyl, heteroaryl, heteroaryl-C$_{1-4}$alkyl, heteroaryl-C$_{1-4}$alkyl-amino, heteroaryl-C$_{1-4}$alkyl-amino-carbonyl, heteroaryl-C$_{1-4}$alkyl-carbonyl-amino, heteroaryl-C$_{1-4}$alkyl-amino-carbonyl-C$_{1-4}$alkyl, heteroaryl-C$_{1-4}$alkyl-carbonyl-amino-C$_{1-4}$alkyl, heterocyclyl, heterocyclyl-C$_{1-4}$alkyl, heterocyclyl-C$_{1-4}$alkoxy, phenyl, or phenyl-C$_{1-4}$alkoxy, wherein heteroaryl is a saturated monocyclic or bicyclic ring system having 1, 2, or 3 heteroatom ring members selected from N, O, and S, wherein heterocyclyl is a saturated or partially unsaturated monocyclic or bicyclic ring system having 1, 2, or 3 heteroatom ring members selected from N, O, and S, and wherein each instance of phenyl, heteroaryl or heterocyclyl is optionally substituted with 1, or 2 substituents each selected from R$_3$;

R$_2$ is halogen, hydroxyl, cyano, oxo, hydroxyl-imino, C$_{1-4}$alkyl, halo-C$_{1-4}$alkyl, amino, (C$_{1-4}$alkyl)$_2$-amino, amino-C$_{1-4}$alkyl, amino-carbonyl, hydroxyl-C$_{1-4}$alkyl, C$_{1-4}$alkoxy, C$_{1-4}$alkoxy-carbonyl, C$_{2-4}$alkenyl, C$_{3-7}$cycloalkyl, or heterocyclyl-C$_{1-4}$alkyl;

R$_3$ is halogen, hydroxyl, nitro, oxo, hydroxyl-imino, C$_{1-4}$alkyl, amino, C$_{1-4}$alkyl-amino, (C$_{1-4}$alkyl)$_2$-amino, amino-C$_{1-4}$alkyl, C$_{1-4}$alkyl-amino-C$_{1-4}$alkyl, (C$_{1-4}$alkyl)$_2$-amino-C$_{1-4}$alkyl, amino-carbonyl, C$_{1-4}$alkyl-amino-carbonyl, C$_{1-4}$alkyl-amino-carbonyl-C$_{1-4}$alkyl, C$_{1-4}$alkyl-carbonyl-amino, C$_{1-4}$alkyl-carbonyl-amino-C$_{1-4}$alkyl, hydroxyl-C$_{1-4}$alkyl, C$_{1-4}$alkyl-carbonyl, C$_{1-4}$alkoxy, halo-C$_{1-4}$alkoxy, amino-C$_{1-4}$alkoxy, hydroxyl-C$_{1-4}$alkoxy, C$_{1-4}$alkyl-C$_{1-4}$alkoxy, C$_{1-4}$alkyl-amino-C$_{1-4}$alkoxy, (C$_{1-4}$alkyl)$_2$-amino-C$_{1-4}$alkoxy, C$_{1-4}$alkyl-carbonyl-amino-C$_{1-4}$alkoxy, C$_{1-4}$alkoxy-C$_{1-4}$alkoxy, C$_{1-4}$alkoxy-carbonyl, C$_{1-4}$alkoxy-carbonyl-amino, C$_{1-4}$alkoxy-carbonyl-amino-C$_{1-4}$alkoxy, C$_{2-4}$alkenyl, C$_{2-4}$alkenyl-amino-carbonyl, C$_{3-7}$cycloalkyl, C$_{3-7}$cycloalkyl-C$_{1-4}$alkoxy, C$_{3-7}$cycloalkenyl, heteroaryl, heteroaryl-C$_{1-4}$alkyl, heteroaryl-C$_{1-4}$alkyl-amino, heteroaryl-C$_{1-4}$alkyl-amino-carbonyl, heteroaryl-C$_{1-4}$alkyl-carbonyl-amino, heteroaryl-C$_{1-4}$alkyl-amino-carbonyl-C$_{1-4}$alkyl, heteroaryl-C$_{1-4}$alkylcarbonyl-amino-$C_{1-4}$alkyl, heterocyclyl, heterocyclyl-$C_{1-4}$alkyl, phenyl; or phenyl-$C_{1-4}$alkoxy;

$R_4$ is independently selected from halogen, $C_{1-4}$alkyl, hydroxyl-$C_{1-4}$alkyl, amino, $C_{1-4}$alkyl-amino, $(C_{1-4}$alkyl$)_2$-amino or hydroxyl-$C_{1-4}$alkyl-amino; and $R_5$ is hydrogen, $C_{1-4}$alkyl, or hydroxyl-$C_{1-4}$alkyl;

wherein a form of the compound is selected from the group consisting of a prodrug, salt, hydrate, solvate, clathrate, isotopologue, racemate, enantiomer, diastereomer, stereoisomer, polymorph and tautomer form thereof.

In one aspect, provided herein is a method for modifying RNA splicing in order to modulate the amount of an RNA transcript produced from precursor RNA comprising a RNA nucleotide sequence in 5' to 3' order: a branch point; a 3' splice site and an endogenous or non-endogenous intronic recognition element for splicing modifier (REMS), wherein the intronic REMS comprises an RNA sequence NNGAgurngn (SEQ ID NO: 1), wherein r is adenine or guanine and n or N is any nucleotide, the method comprising contacting the precursor RNA with a compound of Formula (I) or a form thereof wherein the compound of Formula (I) is:

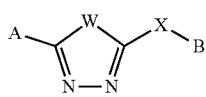

(I)

or a form thereof, wherein

W is CH=CH or S;

X is $CH_2$, $CH(C_{1-4}$alkyl), $C(C_{1-4}$alkyl$)_2$, CH=CH, O, $NR_5$, or a bond;

A is aryl, heteroaryl, heterocyclyl, or $C_{9-10}$cycloalkyl, wherein aryl is selected from phenyl and naphthyl, each optionally substituted with 1, 2, 3, or 4 substituents each selected from $R_1$, wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from $R_2$, and wherein $C_{9-10}$cycloalkyl is a saturated or partially unsaturated bicyclic ring system optionally substituted with 1, 2, 3; 4, or 5 substituents each selected from $R_2$;

B is heterocyclyl, wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from $R_4$;

$R_1$ is halogen, hydroxyl, cyano, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-carbonyl, $C_{1-4}$-alkyl-amino-carbonyl-$C_{1-4}$alkyl, $(C_{1-4}$alkyl$)_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $(C_{1-4}$alkyl$)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, heterocyclyl-$C_{1-4}$alkoxy, phenyl, or phenyl-$C_{1-4}$alkoxy, wherein heteroaryl is a saturated monocyclic or bicyclic ring system having 1, 2, or 3 heteroatom ring members selected from N, O, and S, wherein heterocyclyl is a saturated or partially unsaturated monocyclic or bicyclic ring system having 1, 2, or 3 heteroatom ring members selected from N, O, and S, and wherein each instance of phenyl, heteroaryl or heterocyclyl is optionally substituted with 1, or 2 substituents each selected from $R_3$;

$R_2$ is halogen, hydroxyl, cyano, oxo, hydroxyl-imino, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, hydroxyl-$C_{1-4}$alkyl, $C_{1-4}$alkoxy, $C_{1-4}$alkoxy-carbonyl, $C_{2-4}$alkenyl, $C_{3-7}$cycloalkyl, or heterocyclyl-$C_{1-4}$alkyl, wherein heterocyclyl is a saturated or partially unsaturated monocyclic or bicyclic ring system having 1, 2, or 3 heteroatom ring members selected from N, O, and S, and wherein each instance of heterocyclyl is optionally substituted with 1, or 2 substituents each selected from $R_3$;

$R_3$ is halogen, hydroxyl, nitro, oxo, hydroxyl-imino, $C_{1-4}$alkyl, halo-$C_{1-4}$alkyl, amino, $(C_{1-4}$alkyl)-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, $C_{1-4}$alkyl-amino-carbonyl, $(C_{1-4}$alkyl$)_2$-amino-carbonyl, $C_{1-4}$alkyl-amino-carbonyl-$C_{1-4}$alkyl, $(C_{1-4}$alkyl$)_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}$alkyl$)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, phenyl, or phenyl-$C_{1-4}$alkoxy;

$R_4$ is independently selected from halogen, $C_{1-4}$alkyl, hydroxyl-$C_{1-4}$alkyl, amino, $C_{1-4}$alkyl-amino, $(C_{1-4}$alkyl$)_2$-amino or hydroxyl-$C_{1-4}$alkyl-amino; and $R_5$ is hydrogen, $C_{1-4}$alkyl, or hydroxyl-$C_{1-4}$alkyl;

wherein a form of the compound is selected from the group consisting of a prodrug, salt, hydrate, solvate, clathrate, isotopologue, racemate, enantiomer, diastereomer, stereoisomer, polymorph and tautomer form thereof.

In another aspect, provided herein is a method for modifying RNA splicing in order to modulate the amount of an RNA transcript produced from precursor RNA comprising a RNA nucleotide sequence in 5' to 3' order: a branch point, a 3' splice site and an endogenous or non-endogenous intronic recognition element for splicing modifier (REMS), wherein the intronic REMS comprises an RNA sequence NNGAgurngn (SEQ ID NO: 1), wherein r is adenine or guanine and n or N is any nucleotide, the method comprising contacting the precursor RNA with a compound of Formula (I) or a form thereof, wherein the compound of Formula (I) is selected from a compound of Formula (Ia) and Formula (Ib):

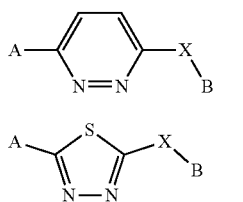

or a form thereof, wherein
X is $CH_2$, $CH(C_{1-4}alkyl)$, $C(C_{1-4}alkyl)_2$, $CH=CH$, O, $NR_5$, or a bond;
A is aryl, heteroaryl, heterocyclyl, or $C_{9-10}$cycloalkyl,
wherein aryl is selected from phenyl and naphthyl, each optionally substituted with 1, 2, 3, or 4 substituents each selected from $R_1$,
wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from $R_1$,
wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from $R_2$, and
wherein $C_{9-10}$cycloalkyl is a saturated or partially unsaturated bicyclic ring system optionally substituted with 1, 2, 3, 4, or 5 substituents each selected from $R_2$;
B is heterocyclyl,
wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from $R_4$;
$R_1$ is halogen, hydroxyl, cyano, $C_{1-4}$alkyl, halo-$C_{1-4}$alkyl, amino, $C_{1-4}$alkyl-amino, $(C_{1-4}alkyl)_2$-amino, amino-$C_{1-4}$alkyl, $C_{1-4}$alkyl-amino-$C_{1-4}$alkyl, $(C_{1-4}alkyl)_2$-amino-$C_{1-4}$alkyl, amino-carbonyl, $C_{1-4}$alkyl-amino-carbonyl, $C_{1-4}$alkyl-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}alkyl)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, heterocyclyl-$C_{1-4}$alkoxy, phenyl, or phenyl-$C_{1-4}$alkoxy,
wherein heteroaryl is a saturated monocyclic or bicyclic ring system having 1, 2, or 3 heteroatom ring members selected from N, O, and S,
wherein heterocyclyl is a saturated or partially unsaturated monocyclic or bicyclic ring system having 1, 2, or 3 heteroatom ring members selected from N, O, and S, and
wherein each instance of phenyl, heteroaryl or heterocyclyl is optionally substituted with 1, or 2 substituents each selected from $R_3$;
$R_2$ is halogen, hydroxyl, cyano, oxo, hydroxyl-imino, $C_{1-4}$alkyl, halo-$C_{1-4}$alkyl, amino, $C_{1-4}$alkyl-amino, $(C_{1-4}alkyl)_2$-amino, amino-$C_{1-4}$alkyl, amino-carbonyl, hydroxyl-$C_{1-4}$alkyl, $C_{1-4}$alkoxy, $C_{1-4}$alkoxy-carbonyl, $C_{2-4}$alkenyl, $C_{3-7}$cycloalkyl, or heterocyclyl-$C_{1-4}$alkyl;
$R_3$ is halogen, hydroxyl, nitro, oxo, hydroxyl-imino, $C_{1-4}$alkyl, amino, $C_{1-4}$alkyl-amino, $(C_{1-4}alkyl)_2$-amino, amino-$C_{1-4}$alkyl, $C_{1-4}$alkyl-amino-$C_{1-4}$alkyl, $(C_{1-4}alkyl)_2$-amino-$C_{1-4}$alkyl, amino-carbonyl, $C_{1-4}$alkyl-amino-carbonyl, $C_{1-4}$alkyl-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}alkyl)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, phenyl, or phenyl-$C_{1-4}$alkoxy;
$R_1$ is independently selected from halogen, $C_{1-4}$alkyl, hydroxyl-$C_{1-4}$alkyl, amino, $C_{1-4}$alkyl-amino, $(C_{1-4}alkyl)_2$-amino or hydroxyl-$C_{1-4}$alkyl-amino; and
$R_5$ is hydrogen, $C_{1-4}$alkyl, or hydroxyl-$C_{1-4}$alkyl;
wherein a form of the compound is selected from the group consisting of a prodrug, salt, hydrate, solvate, clathrate, isotopologue, racemate, enantiomer, diastereomer, stereoisomer, polymorph and tautomer form thereof.

In one aspect, provided herein is a method of modifying RNA splicing in order to modulate the amount and type of a protein produced by a gene comprising a DNA nucleotide sequence encoding an endogenous or non-endogenous intronic REMS in a subject, wherein the DNA nucleotide sequence comprises in 5' to 3' order: a nucleotide sequence encoding a branch point, a nucleotide sequence encoding a 3' splice site and a nucleotide sequence encoding an endogenous or non-endogenous intronic REMS, wherein the nucleotide sequence encoding the endogenous or non-endogenous intronic REMS comprises a DNA sequence GAgtrngn, wherein r is adenine or guanine and n is any nucleotide, the method comprising administering a compound of Formula (I) to the subject, wherein the compound of Formula (I) is:

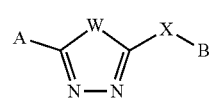

or a form thereof, wherein
W is $CH=CH$ or S;
X is $CH_2$, $CH(C_{1-4}alkyl)$, $C(C_{1-4}alkyl)_2$, $CH=CH$, O, $NR_5$, or a bond;
A is aryl, heteroaryl, heterocyclyl, or $C_{9-10}$cycloalkyl, wherein aryl is selected from phenyl and naphthyl, each optionally substituted with 1, 2, 3, or 4 substituents each selected from $R_1$, wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from $R_1$, wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from $R_2$, and wherein $C_{9-10}$cycloalkyl is a saturated or partially unsaturated bicyclic ring system optionally substituted with 1, 2, 3, 4, or 5 substituents each selected from $R_2$;

B is heterocyclyl, wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from $R_4$;

$R_1$ is halogen, hydroxyl, cyano, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, $C_{1-4}$alkyl-amino-carbonyl, $(C_{1-4}$alkyl$)_2$-amino-carbonyl, $C_{1-4}$alkyl-amino-carbonyl-$C_{1-4}$alkyl, $(C_{1-4}$alkyl$)_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}$alkyl$)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, heterocyclyl-$C_{1-4}$alkoxy, phenyl, or phenyl-$C_{1-4}$alkoxy, wherein heteroaryl is a saturated monocyclic or bicyclic ring system having 1, 2, or 3 heteroatom ring members selected from N, O, and S, wherein heterocyclyl is a saturated or partially unsaturated monocyclic or bicyclic ring system having 1, 2, or 3 heteroatom ring members selected from N, O, and S, and wherein each instance of phenyl, heteroaryl or heterocyclyl is optionally substituted with 1, or 2 substituents each selected from $R_3$;

$R_2$ is halogen, hydroxyl, cyano, oxo, hydroxyl-imino, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, hydroxyl-$C_{1-4}$alkyl, $C_{1-4}$alkoxy, $C_{1-4}$alkoxy-carbonyl, $C_{2-4}$alkenyl, $C_{3-7}$cycloalkyl, or heterocyclyl-$C_{1-4}$alkyl, wherein heterocyclyl is a saturated or partially unsaturated monocyclic or bicyclic ring system having 1, 2, or 3 heteroatom ring members selected from N, O, and S, and wherein each instance of heterocyclyl is optionally substituted with 1, or 2 substituents each selected from $R_3$;

$R_3$ is halogen, hydroxyl, nitro, oxo, hydroxyl-imino, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, $C_{1-4}$alkyl-amino-carbonyl, $(C_{1-4}$alkyl$)_2$-amino-carbonyl, $C_{1-4}$alkyl-amino-carbonyl-$C_{1-4}$alkyl, $(C_{1-4}$alkyl$)_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}$alkyl$)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, phenyl, or phenyl-$C_{1-4}$alkoxy;

$R_4$ is independently selected from halogen, $C_{1-4}$alkyl, hydroxyl-$C_{1-4}$alkyl, amino, $C_{1-4}$alkyl-amino, $(C_{1-4}$alkyl$)_2$-amino or hydroxyl-$C_{1-4}$alkyl-amino; and $R_5$ is hydrogen, $C_{1-4}$alkyl, or hydroxyl-$C_{1-4}$alkyl;

wherein a form of the compound is selected from the group consisting of a prodrug, salt, hydrate, solvate, clathrate, isotopologue, racemate, enantiomer, diastereomer, stereoisomer, polymorph and tautomer form thereof.

In one aspect, provided herein is a method of modifying RNA splicing in order to modulate the amount and type of a protein produced by a gene comprising a DNA nucleotide sequence encoding an endogenous or non-endogenous intronic REMS in a subject, wherein the DNA nucleotide sequence comprises in 5' to 3' order: a nucleotide sequence encoding an endogenous or non-endogenous intronic REMS, a nucleotide sequence encoding a branch point, and a nucleotide sequence encoding a 3' splice site, wherein the nucleotide sequence encoding the endogenous or non-endogenous intronic REMS comprises a DNA sequence GAgtrngn, wherein r is adenine or guanine and n is any nucleotide, the method comprising administering a compound of Formula (I) to the subject, wherein the compound of Formula (I) is:

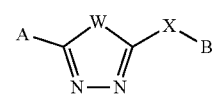

(I)

or a form thereof, wherein

W is CH=CH or S;

X is $CH_2$, $CH(C_{1-4}$alkyl$)$, $C(C_{1-4}$alkyl$)_2$, CH=CH, O, $NR_5$, or a bond;

A is aryl, heteroaryl, heterocyclyl, or $C_{9-10}$cycloalkyl, wherein aryl is selected from phenyl and naphthyl, each optionally substituted with 1, 2, 3, or 4 substituents each selected from $R_1$, wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from $R_1$, wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from $R_2$, and wherein $C_{9-10}$cycloalkyl is a saturated or partially unsaturated bicyclic ring system optionally substituted with 1, 2, 3, 4, or 5 substituents each selected from $R_2$;

B is heterocyclyl, wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from $R_4$;

$R_1$ is halogen, hydroxyl, cyano, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, $C_{1-4}$alkyl-amino-carbonyl, $(C_{1-4}$alkyl$)_2$-amino-carbonyl, $C_{1-4}$alkyl-amino-carbonyl-$C_{1-4}$alkyl, $(C_{1-4}$alkyl$)_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}$alkyl$)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, heterocyclyl-$C_{1-4}$alkoxy, phenyl, or phenyl-$C_{1-4}$alkoxy, wherein heteroaryl is a saturated monocyclic or bicyclic ring system having 1, 2, or 3 heteroatom ring members selected from N, O, and S, wherein heterocyclyl is a saturated or partially unsaturated monocyclic or bicyclic ring system having 1, 2, or 3 heteroatom ring members selected from N, O, and S, and wherein each instance of phenyl, heteroaryl or heterocyclyl is optionally substituted with 1, or 2 substituents each selected from $R_3$;

$R_2$ is halogen, hydroxyl, cyano, oxo, hydroxyl-imino, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, hydroxyl-$C_{1-4}$alkyl, $C_{1-4}$alkoxy, $C_{1-4}$alkoxy-carbonyl, $C_{2-4}$alkenyl, $C_{3-7}$cycloalkyl, or heterocyclyl-$C_{1-4}$alkyl, wherein heterocyclyl is a saturated or partially unsaturated monocyclic or bicyclic ring system having 1, 2, or 3 heteroatom ring members selected from N, O, and S, and wherein each instance of heterocyclyl is optionally substituted with 1, or 2 substituents each selected from $R_3$;

$R_3$ is halogen, hydroxyl, nitro, oxo, hydroxyl-imino, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, $C_{1-4}$alkyl-amino-carbonyl, $(C_{1-4}$alkyl$)_2$-amino-carbonyl, $C_{1-4}$alkyl-amino-carbonyl-$C_{1-4}$alkyl, $(C_{1-4}$alkyl$)_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}$alkyl$)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, phenyl, or phenyl-$C_{1-4}$alkoxy;

$R_4$ is independently selected from halogen, $C_{1-4}$alkyl, hydroxyl-$C_{1-4}$alkyl, amino, $C_{1-4}$alkyl-amino, $(C_{1-4}$alkyl$)_2$-amino or hydroxyl-$C_{1-4}$alkyl-amino; and $R_5$ is hydrogen, $C_{1-4}$alkyl, or hydroxyl-$C_{1-4}$alkyl;

wherein a form of the compound is selected from the group consisting of a prodrug, salt, hydrate, solvate, clathrate, isotopologue, racemate, enantiomer, diastereomer, stereoisomer, polymorph and tautomer form thereof.

In another aspect, provided herein is a method of modifying RNA splicing in order to modulate the amount and type of a protein produced by a gene comprising a DNA nucleotide sequence encoding an endogenous or non-endogenous intronic REMS in a subject, wherein the DNA nucleotide sequence comprises in 5' to 3' order: a nucleotide sequence encoding a branch point, a nucleotide sequence encoding a 3' splice site and a nucleotide sequence encoding an endogenous or non-endogenous intronic REMS, wherein the nucleotide sequence encoding the endogenous or non-endogenous intronic REMS comprises a DNA sequence GAgtrngn, wherein r is adenine or guanine and n is any nucleotide, the method comprising administering a compound of Formula (I) to the subject, wherein the compound of Formula (I) is selected from a compound of Formula (Ia) and Formula (Ib):

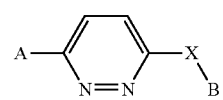

(Ia)

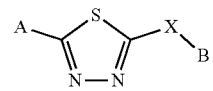

(Ib)

or a form thereof, wherein

X is $CH_2$, $CH(C_{1-4}$alkyl$)$, $C(C_{1-4}$alkyl$)_2$, $CH=CH$, O, $NR_5$, or a bond;

A is aryl, heteroaryl, heterocyclyl, or $C_{9-10}$cycloalkyl, wherein aryl is selected from phenyl and naphthyl, each optionally substituted with 1, 2, 3, or 4 substituents each selected from $R_1$, wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from $R_1$, wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from $R_2$, and wherein $C_{9-10}$cycloalkyl is a saturated or partially unsaturated bicyclic ring system optionally substituted with 1, 2, 3, 4, or 5 substituents each selected from $R_2$;

B is heterocyclyl, wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from $R_4$;

$R_1$ is halogen, hydroxyl, cyano, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, $C_{1-4}$alkyl-amino-carbonyl, $C_{1-4}$alkyl-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}$alkyl$)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, heterocyclyl-$C_{1-4}$alkoxy, phenyl, or phenyl-$C_{1-4}$alkoxy, wherein heteroaryl is a saturated monocyclic or bicyclic ring system having 1, 2, or 3 heteroatom ring members selected from N, O, and S, wherein heterocyclyl is a saturated or partially unsaturated monocyclic or bicyclic ring system having 1, 2, or 3 heteroatom ring members selected from N, O, and S, and wherein each instance of phenyl, heteroaryl or heterocyclyl is optionally substituted with 1, or 2 substituents each selected from $R_3$;

$R_2$ is halogen, hydroxyl, cyano, oxo, hydroxyl-imino, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, amino-carbonyl, hydroxyl-$C_{1-4}$alkyl, $C_{1-4}$alkoxy, $C_{1-4}$alkoxy-carbonyl, $C_{2-4}$alkenyl, $C_{3-7}$cycloalkyl, or heterocyclyl-$C_{1-4}$alkyl;

$R_3$ is halogen, hydroxyl, nitro, oxo, hydroxyl-imino, $C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, $C_{1-4}$alkyl-amino-carbonyl, $C_{1-4}$alkyl-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}$alkyl$)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, phenyl, or phenyl-$C_{1-4}$alkoxy;

$R_4$ is independently selected from halogen, $C_{1-4}$alkyl, hydroxyl-$C_{1-4}$alkyl, amino, $C_{1-4}$alkyl-amino, $(C_{1-4}$alkyl$)_2$-amino or hydroxyl-$C_{1-4}$alkyl-amino; and $R_5$ is hydrogen, $C_{1-4}$alkyl, or hydroxyl-$C_{1-4}$alkyl;

wherein a form of the compound is selected from the group consisting of a prodrug, salt, hydrate, solvate, clathrate, isotopologue, racemate, enantiomer, diastereomer, stereoisomer, polymorph and tautomer form thereof.

In another aspect, provided herein is a method of modifying RNA splicing in order to modulate the amount and type of a protein produced by a gene comprising a DNA nucleotide sequence encoding an endogenous or non-endogenous intronic REMS in a subject, wherein the DNA nucleotide sequence comprises in 5' to 3' order: a nucleotide sequence encoding an endogenous or non-endogenous intronic REMS, a nucleotide sequence encoding a branch point, and a nucleotide sequence encoding a 3' splice site, wherein the nucleotide sequence encoding the endogenous or non-endogenous intronic REMS comprises a DNA sequence GAgtrngn, wherein r is adenine or guanine and n is any nucleotide, the method comprising administering a compound of Formula (I) to the subject, wherein the compound of Formula (I) is selected from a compound of Formula (Ia) and Formula (Ib):

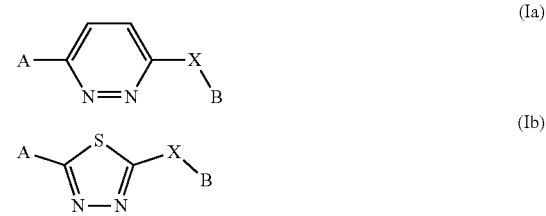

or a form thereof, wherein

X is $CH_2$, $CH(C_{1-4}$alkyl$)$, $C(C_{1-4}$alkyl$)_2$, CH=CH, O, $NR_5$, or a bond;

A is aryl, heteroaryl, heterocyclyl, or $C_{9-10}$cycloalkyl, wherein aryl is selected from phenyl and naphthyl, each optionally substituted with 1, 2, 3, or 4 substituents each selected from $R_1$, wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from $R_1$, wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from $R_2$, and wherein $C_{9-10}$cycloalkyl is a saturated or partially unsaturated bicyclic ring system optionally substituted with 1, 2, 3, 4, or 5 substituents each selected from $R_2$;

B is heterocyclyl, wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from $R_4$;

$R_1$ is halogen, hydroxyl, cyano, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, $C_{1-4}$alkyl-amino-carbonyl, $C_{1-4}$alkyl-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}$alkyl$)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, heterocyclyl-$C_{1-4}$alkoxy, phenyl, or phenyl-$C_{1-4}$alkoxy, wherein heteroaryl is a saturated monocyclic or bicyclic ring system having 1, 2, or 3 heteroatom ring members selected from N, O, and S, wherein heterocyclyl is a saturated or partially unsaturated monocyclic or bicyclic ring system having 1, 2, or 3 heteroatom ring members selected from N, O, and S, and wherein each instance of phenyl, heteroaryl or heterocyclyl is optionally substituted with 1, or 2 substituents each selected from $R_3$;

$R_2$ is halogen, hydroxyl, cyano, oxo, hydroxyl-imino, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, amino-carbonyl, hydroxyl-$C_{1-4}$alkyl, $C_{1-4}$alkoxy, $C_{1-4}$alkoxy-carbonyl, $C_{2-4}$alkenyl, $C_{3-7}$cycloalkyl, or heterocyclyl-$C_{1-4}$alkyl;

$R_3$ is halogen, hydroxyl, nitro, oxo, hydroxyl-imino, $C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, $C_{1-4}$alkyl-amino-carbonyl, $C_{1-4}$alkyl-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}$alkyl$)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, phenyl, or phenyl-$C_{1-4}$alkoxy;

$R_4$ is independently selected from halogen, $C_{1-4}$alkyl, hydroxyl-$C_{1-4}$alkyl, amino, $C_{1-4}$alkyl-amino, $(C_{1-4}$alkyl$)_2$-amino or hydroxyl-$C_{1-4}$alkyl-amino; and $R_5$ is hydrogen, $C_{1-4}$alkyl, or hydroxyl-$C_{1-4}$alkyl;

wherein a form of the compound is selected from the group consisting of a prodrug, salt, hydrate, solvate, clathrate, isotopologue, racemate, enantiomer, diastereomer, stereoisomer, polymorph and tautomer form thereof.

In one aspect, provided herein is a method of modifying RNA splicing in order to modulate the amount and type of a protein produced by a gene comprising a DNA nucleotide sequence encoding an endogenous or non-endogenous intronic REMS in a subject, wherein the DNA nucleotide sequence comprises in 5' to 3' order: a nucleotide sequence encoding a branch point, a nucleotide sequence encoding a 3' splice site and a nucleotide sequence encoding an endogenous or non-endogenous intronic REMS, wherein the nucleotide sequence encoding the endogenous or non-endogenous intronic REMS comprises a DNA sequence NNGAgtrngn (SEQ ID NO: 1808), wherein r is adenine or guanine and n or N is any nucleotide, the method comprising administering a compound of Formula (I) to the subject, wherein the compound of Formula (I) is:

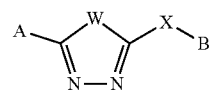

or a form thereof, wherein

W is CH=CH or S;

X is $CH_2$, $CH(C_{1-4}alkyl)$, $C(C_{1-4}alkyl)_2$, CH=CH, O, $NR_5$, or a bond;

A is aryl, heteroaryl, heterocyclyl, or $C_{9-10}$cycloalkyl, wherein aryl is selected from phenyl and naphthyl, each optionally substituted with 1, 2, 3, or 4 substituents each selected from $R_1$, wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from $R_1$, wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from $R_2$, and wherein $C_{9-10}$cycloalkyl is a saturated or partially unsaturated bicyclic ring system optionally substituted with 1, 2, 3, 4, or 5 substituents each selected from $R_2$;

B is heterocyclyl, wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from $R_4$;

$R_1$ is halogen, hydroxyl, cyano, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, $C_{1-4}$alkyl-amino-carbonyl, $(C_{1-4}$alkyl$)_2$-amino-carbonyl, $C_{1-4}$alkyl-amino-carbonyl-$C_{1-4}$alkyl, $(C_{1-4}$alkyl$)_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}$alkyl$)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, heterocyclyl-$C_{1-4}$alkoxy, phenyl, or phenyl-$C_{1-4}$alkoxy, wherein heteroaryl is a saturated monocyclic or bicyclic ring system having 1, 2, or 3 heteroatom ring members selected from N, O, and S, wherein heterocyclyl is a saturated or partially unsaturated monocyclic or bicyclic ring system having 1, 2, or 3 heteroatom ring members selected from N, O, and S, and wherein each instance of phenyl, heteroaryl or heterocyclyl is optionally substituted with 1, or 2 substituents each selected from $R_3$;

$R_2$ is halogen, hydroxyl, cyano, oxo, hydroxyl-imino, $C_{1-4}$alkyl, halo-$C_{1-4}$alkyl, amino, $C_{1-4}$alkyl-amino, $(C_{1-}$ 4alkyl)$_2$-amino, amino-C$_{1-4}$alkyl, C$_{1-4}$alkyl-amino-C$_{1-4}$alkyl, (C$_{1-4}$alkyl)$_2$-amino-C$_{1-4}$alkyl, amino-carbonyl, hydroxyl-C$_{1-4}$alkyl, C$_{1-4}$alkoxy, C$_{1-4}$alkoxy-carbonyl, C$_{2-4}$alkenyl, C$_{3-7}$cycloalkyl, or heterocyclyl-C$_{1-4}$alkyl, wherein heterocyclyl is a saturated or partially unsaturated monocyclic or bicyclic ring system having 1, 2, or 3 heteroatom ring members selected from N, O, and S, and wherein each instance of heterocyclyl is optionally substituted with 1, or 2 substituents each selected from R$_3$;

R$_3$ is halogen, hydroxyl, nitro, oxo, hydroxyl-imino, C$_{1-4}$alkyl, halo-C$_{1-4}$alkyl, amino, C$_{1-4}$alkyl-amino, (C$_{1-4}$alkyl)$_2$-amino, amino-C$_{1-4}$alkyl, C$_{1-4}$alkyl-amino-C$_{1-4}$alkyl, (C$_{1-4}$alkyl)$_2$-amino-C$_{1-4}$alkyl, amino-carbonyl, C$_{1-4}$alkyl-amino-carbonyl, (C$_{1-4}$alkyl)$_2$-amino-carbonyl, C$_{1-4}$alkyl-amino-carbonyl-C$_{1-4}$alkyl, (C$_{1-4}$alkyl)$_2$-amino-carbonyl-C$_{1-4}$alkyl, C$_{1-4}$alkyl-carbonyl-amino, C$_{1-4}$alkyl-carbonyl-amino-C$_{1-4}$alkyl, hydroxyl-C$_{1-4}$alkyl, C$_{1-4}$alkyl-carbonyl, C$_{1-4}$alkoxy, halo-C$_{1-4}$alkoxy, amino-C$_{1-4}$alkoxy, hydroxyl-C$_{1-4}$alkoxy, C$_{1-4}$alkyl-C$_{1-4}$alkoxy, C$_{1-4}$alkyl-amino-C$_{1-4}$alkoxy, (C$_{1-4}$alkyl)$_2$-amino-C$_{1-4}$alkoxy, C$_{1-4}$alkyl-carbonyl-amino-C$_{1-4}$alkoxy, C$_{1-4}$alkoxy-C$_{1-4}$alkoxy, C$_{1-4}$alkoxy-carbonyl, C$_{1-4}$alkoxy-carbonyl-amino, C$_{1-4}$alkoxy-carbonyl-amino-C$_{1-4}$alkoxy, C$_{2-4}$alkenyl, C$_{2-4}$alkenyl-amino-carbonyl, C$_{3-7}$cycloalkyl, C$_{3-7}$cycloalkyl-C$_{1-4}$alkoxy, C$_{3-7}$cycloalkenyl, heteroaryl, heteroaryl-C$_{1-4}$alkyl, heteroaryl-C$_{1-4}$alkyl-amino, heteroaryl-C$_{1-4}$alkyl-amino-carbonyl, heteroaryl-C$_{1-4}$alkyl-carbonyl-amino, heteroaryl-C$_{1-4}$alkyl-amino-carbonyl-C$_{1-4}$alkyl, heteroaryl-C$_{1-4}$alkyl-carbonyl-amino-C$_{1-4}$alkyl, heterocyclyl, heterocyclyl-C$_{1-4}$alkyl, phenyl, or phenyl-C$_{1-4}$alkoxy;

R$_4$ is independently selected from halogen, C$_{1-4}$alkyl, hydroxyl-C$_{1-4}$alkyl, amino, C$_{1-4}$alkyl-amino, (C$_{1-4}$alkyl)$_2$-amino or hydroxyl-C$_{1-4}$alkyl-amino; and R$_5$ is hydrogen, C$_{1-4}$alkyl, or hydroxyl-C$_{1-4}$alkyl;

wherein a form of the compound is selected from the group consisting of a prodrug, salt, hydrate, solvate, clathrate, isotopologue, racemate, enantiomer, diastereomer, stereoisomer, polymorph and tautomer form thereof.

In one aspect, provided herein is a method of modifying RNA splicing in order to modulate the amount and type of a protein produced by a gene comprising a DNA nucleotide sequence encoding an endogenous or non-endogenous intronic REMS in a subject, wherein the DNA nucleotide sequence comprises in 5' to 3' order: a nucleotide sequence encoding an endogenous or non-endogenous intronic REMS, a nucleotide sequence encoding a branch point, and a nucleotide sequence encoding a 3' splice site, wherein the nucleotide sequence encoding the endogenous or non-endogenous intronic REMS comprises a DNA sequence NNGAgtrngn (SEQ ID NO: 1808), wherein r is adenine or guanine and n or N is any nucleotide, the method comprising administering a compound of Formula (I) to the subject, wherein the compound of Formula (I) is:

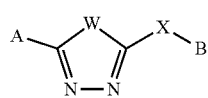
(I)

or a form thereof, wherein

W is CH=CH or S;

X is CH$_2$, CH(C$_{1-4}$alkyl), C(C$_{1-4}$alkyl)$_2$, CH=CH, O, NR$_5$, or a bond;

A is aryl, heteroaryl, heterocyclyl, or C$_{9-10}$cycloalkyl, wherein aryl is selected from phenyl and naphthyl, each optionally substituted with 1, 2, 3, or 4 substituents each selected from R$_1$, wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from R$_1$, wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from R$_2$, and wherein C$_{9-10}$cycloalkyl is a saturated or partially unsaturated bicyclic ring system optionally substituted with 1, 2, 3, 4, or 5 substituents each selected from R$_2$;

B is heterocyclyl, wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from R$_4$;

R$_1$ is halogen, hydroxyl, cyano, C$_{1-4}$alkyl, halo-C$_{1-4}$alkyl, amino, C$_{1-4}$alkyl-amino, (C$_{1-4}$alkyl)$_2$-amino, amino-C$_{1-4}$alkyl, C$_{1-4}$alkyl-amino-C$_{1-4}$alkyl, (C$_{1-4}$alkyl)$_2$-amino-C$_{1-4}$alkyl, amino-carbonyl, C$_{1-4}$alkyl-amino-carbonyl, (C$_{1-4}$alkyl)$_2$-amino-carbonyl, C$_{1-4}$alkyl-amino-carbonyl-C$_{1-4}$alkyl, (C$_{1-4}$alkyl)$_2$-amino-carbonyl-C$_{1-4}$alkyl, C$_{1-4}$alkyl-carbonyl-amino, C$_{1-4}$alkyl-carbonyl-amino-C$_{1-4}$alkyl, hydroxyl-C$_{1-4}$alkyl, C$_{1-4}$alkyl-carbonyl, C$_{1-4}$alkoxy, halo-C$_{1-4}$alkoxy, amino-C$_{1-4}$alkoxy, hydroxyl-C$_{1-4}$alkoxy, C$_{1-4}$alkyl-C$_{1-4}$alkoxy, C$_{1-4}$alkyl-amino-C$_{1-4}$alkoxy, (C$_{1-4}$alkyl)$_2$-amino-C$_{1-4}$alkoxy, C$_{1-4}$alkyl-carbonyl-amino-C$_{1-4}$alkoxy, C$_{1-4}$alkoxy-C$_{1-4}$alkoxy, C$_{1-4}$alkoxy-carbonyl, C$_{1-4}$alkoxy-carbonyl-amino, C$_{1-4}$alkoxy-carbonyl-amino-C$_{1-4}$alkoxy, C$_{2-4}$alkenyl, C$_{2-4}$alkenyl-amino-carbonyl, C$_{3-7}$cycloalkyl, C$_{3-7}$cycloalkyl-C$_{1-4}$alkoxy, C$_{3-7}$cycloalkenyl, heteroaryl, heteroaryl-C$_{1-4}$alkyl, heteroaryl-C$_{1-4}$alkyl-amino, heteroaryl-C$_{1-4}$alkyl-amino-carbonyl, heteroaryl-C$_{1-4}$alkyl-carbonyl-amino, heteroaryl-C$_{1-4}$alkyl-amino-carbonyl-C$_{1-4}$alkyl, heteroaryl-C$_{1-4}$alkyl-carbonyl-amino-C$_{1-4}$alkyl, heterocyclyl, heterocyclyl-C$_{1-4}$alkyl, heterocyclyl-C$_{1-4}$alkoxy, phenyl, or phenyl-C$_{1-4}$alkoxy, wherein heteroaryl is a saturated monocyclic or bicyclic ring system having 1, 2, or 3 heteroatom ring members selected from N, O, and S, wherein heterocyclyl is a saturated or partially unsaturated monocyclic or bicyclic ring system having 1, 2, or 3 heteroatom ring members selected from N, O, and S, and wherein each instance of phenyl, heteroaryl or heterocyclyl is optionally substituted with 1, or 2 substituents each selected from R$_3$;

R$_2$ is halogen, hydroxyl, cyano, oxo, hydroxyl-imino, C$_{1-4}$alkyl, halo-C$_{1-4}$alkyl, amino, C$_{1-4}$alkyl-amino, (C$_{1-4}$alkyl)$_2$-amino, amino-C$_{1-4}$alkyl, C$_{1-4}$alkyl-amino-C$_{1-4}$alkyl, (C$_{1-4}$alkyl)$_2$-amino-C$_{1-4}$alkyl, amino-carbonyl, hydroxyl-C$_{1-4}$alkyl, C$_{1-4}$alkoxy, C$_{1-4}$alkoxy-carbonyl, C$_{2-4}$alkenyl, C$_{3-7}$cycloalkyl, or heterocyclyl-C$_{1-4}$alkyl, wherein heterocyclyl is a saturated or partially unsaturated monocyclic or bicyclic ring system having 1, 2, or 3 heteroatom ring members selected from N, O, and S, and wherein each instance of heterocyclyl is optionally substituted with 1, or 2 substituents each selected from R$_3$;

R$_3$ is halogen, hydroxyl, nitro, oxo, hydroxyl-imino, C$_{1-4}$alkyl, halo-C$_{1-4}$alkyl, amino, C$_{1-4}$alkyl-amino, (C$_{1-4}$alkyl)$_2$-amino, amino-C$_{1-4}$alkyl, C$_{1-4}$alkyl-amino-C$_{1-4}$alkyl, ($C_{1-4}$alkyl)$_2$-amino-$C_{1-4}$alkyl, amino-carbonyl, $C_{1-4}$alkyl-amino-carbonyl, ($C_{1-4}$alkyl)$_2$-amino-carbonyl, $C_{1-4}$alkyl-amino-carbonyl-$C_{1-4}$alkyl, ($C_{1-4}$alkyl)$_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, ($C_{1-4}$alkyl)$_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, phenyl, or phenyl-$C_{1-4}$alkoxy;

$R_4$ is independently selected from halogen, $C_{1-4}$alkyl, hydroxyl-$C_{1-4}$alkyl, amino, $C_{1-4}$alkyl-amino, ($C_{1-4}$alkyl)$_2$-amino or hydroxyl-$C_{1-4}$alkyl-amino; and $R_5$ is hydrogen, $C_{1-4}$alkyl, or hydroxyl-$C_{1-4}$alkyl;

wherein a form of the compound is selected from the group consisting of a prodrug, salt, hydrate, solvate, clathrate, isotopologue, racemate, enantiomer, diastereomer, stereoisomer, polymorph and tautomer form thereof.

In another aspect, provided herein is a method of modifying RNA splicing in order to modulate the amount and type of a protein produced by a gene comprising a DNA nucleotide sequence encoding an endogenous or non-endogenous intronic REMS in a subject, wherein the DNA nucleotide sequence comprises in 5' to 3' order: a nucleotide sequence encoding a branch point, a nucleotide sequence encoding a 3' splice site and a nucleotide sequence encoding an endogenous or non-endogenous intronic REMS, wherein the nucleotide sequence encoding the endogenous or non-endogenous intronic REMS comprises a DNA sequence NNGAgtrngn (SEQ ID NO: 1808), wherein r is adenine or guanine and n or N is any nucleotide, the method comprising administering a compound of Formula (I) to the subject, wherein the compound of Formula (I) is selected from a compound of Formula (Ia) and Formula (Ib):

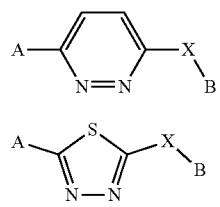

(Ia)

(Ib)

or a form thereof, wherein

X is $CH_2$, $CH(C_{1-4}alkyl)$, $C(C_{1-4}alkyl)_2$, CH=CH, O, $NR_5$, or a bond;

A is aryl, heteroaryl, heterocyclyl, or $C_{9-10}$cycloalkyl, wherein aryl is selected from phenyl and naphthyl, each optionally substituted with 1, 2, 3, or 4 substituents each selected from $R_1$, wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from $R_1$, wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from $R_2$, and wherein $C_{9-10}$cycloalkyl is a saturated or partially unsaturated bicyclic ring system optionally substituted with 1, 2, 3, 4, or 5 substituents each selected from $R_2$;

B is heterocyclyl, wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from $R_4$;

$R_1$ is halogen, hydroxyl, cyano, $C_{1-4}$alkyl, halo-$C_{1-4}$alkyl, amino, $C_{1-4}$alkyl-amino, ($C_{1-4}$alkyl)$_2$-amino, amino-$C_{1-4}$alkyl, $C_{1-4}$alkyl-amino-$C_{1-4}$alkyl, ($C_{1-4}$alkyl)$_2$-amino-$C_{1-4}$alkyl, amino-carbonyl, $C_{1-4}$alkyl-amino-carbonyl, $C_{1-4}$alkyl-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, ($C_{1-4}$alkyl)$_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, heterocyclyl-$C_{1-4}$alkoxy, phenyl, or phenyl-$C_{1-4}$alkoxy, wherein heteroaryl is a saturated monocyclic or bicyclic ring system having 1, 2, or 3 heteroatom ring members selected from N, O, and S, wherein heterocyclyl is a saturated or partially unsaturated monocyclic or bicyclic ring system having 1, 2, or 3 heteroatom ring members selected from N, O, and S, and wherein each instance of phenyl, heteroaryl or heterocyclyl is optionally substituted with 1, or 2 substituents each selected from $R_3$;

$R_2$ is halogen, hydroxyl, cyano, oxo, hydroxyl-imino, $C_{1-4}$alkyl, halo-$C_{1-4}$alkyl, amino, $C_{1-4}$alkyl-amino, ($C_{1-4}$alkyl)$_2$-amino, amino-$C_{1-4}$alkyl, amino-carbonyl, hydroxyl-$C_{1-4}$alkyl, $C_{1-4}$alkoxy, $C_{1-4}$alkoxy-carbonyl, $C_{2-4}$alkenyl, $C_{3-7}$cycloalkyl, or heterocyclyl-$C_{1-4}$alkyl;

$R_3$ is halogen, hydroxyl, nitro, oxo, hydroxyl-imino, $C_{1-4}$alkyl, amino, $C_{1-4}$alkyl-amino, ($C_{1-4}$alkyl)$_2$-amino, amino-$C_{1-4}$alkyl, $C_{1-4}$alkyl-amino-$C_{1-4}$alkyl, ($C_{1-4}$alkyl)$_2$-amino-$C_{1-4}$alkyl, amino-carbonyl, $C_{1-4}$alkyl-amino-carbonyl, $C_{1-4}$alkyl-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, ($C_{1-4}$alkyl)$_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkylcarbonyl-amino-$C_{1-4}$alkyl, heterocyclyl, heterocyclyl-$C_{1-4}$alkyl, phenyl, or phenyl-$C_{1-4}$alkoxy;

$R_4$ is independently selected from halogen, $C_{1-4}$alkyl, hydroxyl-$C_{1-4}$alkyl, amino, $C_{1-4}$alkyl-amino, $(C_{1-4}$alkyl$)_2$-amino or hydroxyl-$C_{1-4}$alkyl-amino; and $R_5$ is hydrogen, $C_{1-4}$alkyl, or hydroxyl-$C_{1-4}$alkyl;

wherein a form of the compound is selected from the group consisting of a prodrug, salt, hydrate, solvate, clathrate, isotopologue, racemate, enantiomer, diastereomer, stereoisomer, polymorph and tautomer form thereof.

In another aspect, provided herein is a method of modifying RNA splicing in order to modulate the amount and type of a protein produced by a gene comprising a DNA nucleotide sequence encoding an endogenous or non-endogenous intronic REMS in a subject, wherein the DNA nucleotide sequence comprises in 5' to 3' order: a nucleotide sequence encoding an endogenous or non-endogenous intronic REMS, a nucleotide sequence encoding a branch point, and a nucleotide sequence encoding a 3' splice site, wherein the nucleotide sequence encoding the endogenous or non-endogenous intronic REMS comprises a DNA sequence NNGAgtrngn (SEQ ID NO: 1808), wherein r is adenine or guanine and n or N is any nucleotide, the method comprising administering a compound of Formula (I) to the subject, wherein the compound of Formula (I) is selected from a compound of Formula (Ia) and Formula (Ib):

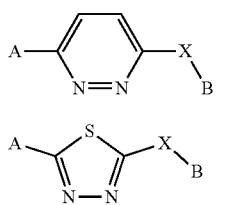

or a form thereof, wherein

X is $CH_2$, $CH(C_{1-4}$alkyl$)$, $C(C_{1-4}$alkyl$)_2$, CH=CH, O, $NR_5$, or a bond;

A is aryl, heteroaryl, heterocyclyl, or $C_{9-10}$cycloalkyl, wherein aryl is selected from phenyl and naphthyl, each optionally substituted with 1, 2, 3, or 4 substituents each selected from $R_1$, wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from $R_1$, wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from $R_2$, and wherein $C_{9-10}$cycloalkyl is a saturated or partially unsaturated bicyclic ring system optionally substituted with 1, 2, 3, 4, or 5 substituents each selected from $R_2$;

B is heterocyclyl, wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from $R_4$;

$R_1$ is halogen, hydroxyl, cyano, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, $C_{1-4}$alkyl-amino-carbonyl, $C_{1-4}$alkyl-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}$alkyl$)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, heterocyclyl-$C_{1-4}$alkoxy, phenyl, or phenyl-$C_{1-4}$alkoxy, wherein heteroaryl is a saturated monocyclic or bicyclic ring system having 1, 2, or 3 heteroatom ring members selected from N, O, and S, wherein heterocyclyl is a saturated or partially unsaturated monocyclic or bicyclic ring system having 1, 2, or 3 heteroatom ring members selected from N, O, and S, and wherein each instance of phenyl, heteroaryl or heterocyclyl is optionally substituted with 1, or 2 substituents each selected from $R_3$;

$R_2$ is halogen, hydroxyl, cyano, oxo, hydroxyl-imino, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, amino-carbonyl, hydroxyl-$C_{1-4}$alkyl, $C_{1-4}$alkoxy, $C_{1-4}$alkoxy-carbonyl, $C_{2-4}$alkenyl, $C_{3-7}$cycloalkyl, or heterocyclyl-$C_{1-4}$alkyl;

$R_3$ is halogen, hydroxyl, nitro, oxo, hydroxyl-imino, $C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, $C_{1-4}$alkyl-amino-carbonyl, $C_{1-4}$alkyl-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}$alkyl$)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, phenyl, or phenyl-$C_{1-4}$alkoxy;

$R_4$ is independently selected from halogen, $C_{1-4}$alkyl, hydroxyl-$C_{1-4}$alkyl, amino, $C_{1-4}$alkyl-amino, $(C_{1-4}$alkyl$)_2$-amino or hydroxyl-$C_{1-4}$alkyl-amino; and $R_5$ is hydrogen, $C_{1-4}$alkyl, or hydroxyl-$C_{1-4}$alkyl;

wherein a form of the compound is selected from the group consisting of a prodrug, salt, hydrate, solvate, clathrate, isotopologue, racemate, enantiomer, diastereomer, stereoisomer, polymorph and tautomer form thereof.

In a specific aspect described herein, the gene is, or the RNA transcript is transcribed from a gene that is selected from: ABCA1, ABCA10, ABCB7, ABCB8, ABCC1, ABCC3, ABHD10, ABL2, ABLIM3, ACACA, ACADVL, ACAT2, ACTA2, ADAL, ADAM12, ADAM15, ADAM17, ADAM23, ADAM33, ADAMTS1, ADAMTS19, ADCY3, ADD1, ADGRG6, ADH6, ADHFE1, AFF2, AFF3, AGK, AGPAT3, AGPAT4, AGPS, AHCYL2, AHDC1, AHRR, AJUBA, AK021888, AK310472, AKAP1, AKAP3, AKAP8L, AKAP9, AKNA, AKT1, ALCAM, ALDH4A1, AMPD2, ANK1, ANK2, ANK3, ANKFY1, ANKHD1-EIF4EBP3, ANKRA2, ANKRD13C, ANKRD17, ANKRD33B, ANKRD36, ANKS6, ANP32A, ANXA11, ANXA6, AP2B1, AP4B1-AS1, APAF1, APIP, APLP2, APOA2, APP, APPL2, APTX, ARHGAP1, ARHGAP12, ARHGAP22, ARHGAP5, ARHGEF16, ARID1A, ARID2, ARID5B, ARL9, ARL15, ARL5B, ARMCX3, ARMCX6, ARSJ, ASAP1, ASIC1, ASL, ASNS, ASPH, ATAD2B, ATF6, ATF7IP, ATG5, ATG9A, ATMIN, ATP2A3, ATP2C1, ATXN1, ATXN3, AURKA, AXIN1, B3GALT2, B3GNT6, B4GALT2, BACE1, BAG2, BASP1, BC033281, BCAR3, BCL2L15, BCYRN1, BECN1, BEND6, BHMT2, BICD1, BIN1, BIN3, BIN3-IT1, BIRC3, BIRC6, BNC1, BNC2, BRCA1, BRCA2, BRD2, BRPF1, BSCL2, BTBD10, BTG2, BTN3A1, BZW1, C1QTNF9B-AS1, C1orf27, C1orf86, C10orf54, C11orf30, C11orf70, C11orf73, C11orf76, C11orf94, C12orf4, C12orf56, C14orf132, C17orf76-AS1, C19orf47, C2orf47, C3, C4orf27, C5orf24, C6orf48, C7orf31, C8orf34, C8orf44, C8orf44-SGK3, C8orf88, C9orf69, CA13, CA3, CAB39, CACNA2D2, CACNB1, CACNB4, CADM1, CADM2, CALU, CAMKK1, CAND2, CAPNS1, CASC3, CASP7, CASP8AP2, CAV1, CCAR1, CCDC77, CCDC79, CCDC88A, CCDC92, CCDC122, CCER2, CCNF, CCNL2, CCT6A, CD276, CD46, CDC25B, CDC40, CDC42BPA, CDCA7, CDH11, CDH13, CDH18, CDK11B, CDK16, CDKAL1, CDKN1C, CECR7, CELSR1, CEMIP, CENPI, CEP112, CEP162, CEP170, CEP192, CEP57, CEP68, CFH, CFLAR, CHD8, CHEK1, CHRM2, CITA, CIZ1, CLDN23, CLIC1, CLK4, CLTA, CMAHP, CNGA4, CNOT1, CNRIP1, CNTD1, CMSS1, CNOT7, CNRIP1, CNTN1, COG1, COL1A1, COL11A1, COL2A1, COL4A1, COL5A1, COL5A1, COL5A3, COL6A1, COL6A6, COL8A1, COLEC12, COMP, COPS7B, CPA4, CPEB2, CPQ, CPSF4, CREB5, CRISPLD2, CRLF1, CRLS1, CRTAP, CRX, CRYBG3, CRYL1, CSDE1, CSNK1A1, CSNK1E, CSNK1G1, CTDSP2, CTNND1, CTRC, CUL2, CUL4A, CUX1, CYB5B, CYB5R2, CYBRD1, CYGB, CYP1B1, CYP51A1, DAAM1, DAB2, DACT1, DAGLB, DARS, DAXX, DCAF10, DCAF11, DCAF17, DCBLD2, DCLK1, DCN, DCUN1D4, DDAH1, DDAH2, DDHD2, DDIT4L, DDR1, DDX39B, DDX42, DDX50, DEGS1, DENND1A, DENND1B, DENND4A, DENND5A, DEPTOR, DET1, DFNB59, DGCR2, DGK1, DGKA, DHCR24, DHCR7, DHFR, DHX9, DIAPH1, DIAPH3, DIRAS3, DIS3L, DKFZp434M1735, DKK3, DLC1, DLG5, DLGAP4, DMD, DMXL1, DNAH8, DNAH11, DNAJA4, DNAJC13, DNAJC27, DNM2, DNMBP, DOCK1, DOCK11, DPP8, DSEL, DST, DSTN, DYNC1I1, DYRK1A, DZIP1L, EBF1, EEA1, EEFIA1, EFCAB14, EFEMP1, EGR1, EGR3, EHMT2, EIF2B3, EIF4G1, EIF4G2, EIF4G3, ELF2, ELMO2, ELN, ELP4, EMX2OS, ENAH, ENG, ENOX1, ENPP1, ENPP2, ENSA, EP300, EPN1, EPT1, ERC1, ERC2, ERCC1, ERCC8, ERGIC3, ERLIN2, ERRFI1, ESM1, ETV5, EVC, EVC2, EXO1, EXOC3, EXOC6B, EXTL2, EYA3, F2R, FADS1, FADS2, FAF1, FAIM, FAM111A, FAM126A, FAM13A, FAM160A1, FAM162A, FAM174A, FAM195B, FAM198B, FAM20A, FAM208B, FAM219A, FAM219B, FAM3C, FAM46B, FAM49B, FAM65A, FAM65B, FAM69B, FAP, FARP1, FBLN2, FBN2, FBXL16, FBXL6, FBXO9, FBXO10, FBXO18, FBXO31, FBXO34, FBXO9, FCHO1, FDFT1, FDPS, FER, FEZ1, FGD4, FGD5-AS1, FGFR2, FGFRL1, FGL2, FHOD3, FLII, FLNB, FLT1, FN1, FNBP1, FOCAD, FOS, FOSB, FOSL1, FOXK1, FOXM1, FRAS1, FSCN2, FUS, FYN, GABPB1, GAL3ST4, GALC, GALNT1, GALNT15, GAS7, GATA6, GBA2, GBGT1, GBP1, GCFC2, GLCE, GCNT1, GDF6, GGACT, GGCT, GHDC, GIGYF2, GJC1, GLCE, GMIP, GNA13, GNAQ, GNAS, GNG12, GNL3L, GOLGA2, GOLGA4, GOLGB1, GORASP1, GPR1, GPR183, GPR50, GPR89A, GPRC5A, GPRC5B, GPSM2, GREM1, GRK6, GRTP1, GSE1, GTF2H2B, GTSF1, GUCA1B, GULP1, GXYLT1, HAPLN1, HAPLN2, HAS2, HAS3, HAT1, HAUS3, HAUS6, HAVCR2, HDAC5, HDAC7, HDX, HECTD2-AS1, HEG1, HEPH, HEY1, HLA-A, HLA-E, HLTF, HMGA1, HMGA2, HMGB1, HMGCR, HMGN3-AS1, HMGCS1, HMGXB4, HOOK3, HOXB3, HMOX1, HNMT, HNRNPR, HNRNPUL1, HP1BP3, HPS1, HRH1, HSD17B12, HSD17B4, HSPA1L, HTATIP2, HTT, IARS, IDH1, IDI1, IFT57, IGDCC4, IGF2BP2, IGF2R, IGFBP3, IKBKAP, IL16, IL6ST, INA, INHBA, INO80, IPP4B, INPP5K, INSIG1, INTU, INVS, IQCE, IQCG, ITCH, ITGAI1, ITGA8, ITGAV, ITGB5, ITGB8, ITIH1, ITM2C, ITPKA, ITSN1, IVD, KANSL3, KAT6B, KCNK2, KCNS1, KCNS2, KDM6A, KDSR, KIAA1033, KIAA1143, KIAA1199, KIAA1456, KIAA1462, KIAA1522, KIAA1524, KIAA1549, KIAA1715, KIAA1755, KIDINS220, KIF14, KIF2A, KIF21A, KIF3A, KIT, KLC1, KLC2, KLF17, KLF6, KLHL7, KLRG1, KMT2D, KRT7, KRT18, KRT19, KRT34, KRTAP1-1, KRTAP1-5, KRTAP2-3, L3MBTL2, LAMA2, LAMB1, LAMB2P1, LARP4, LARP7, LATS2, LDLR, LEMD3, LETM2, LGALS3, LGALS8, LGI2, LGR4, LHX9, LIMS1, LINC00341, LINC00472, LINC00570, LINC00578, LINC00607, LINC00657, LINC00678, LINC00702, LINC00886, LINC00961, LINC01011, LINC01118, LINC01204, LINCR-0002, LINGO2, LMAN2L, LMNA, LMO7, LMOD1, LOC400927, LONP1, LOX, LPHN1, LRBA, LRCH4, LRIG1, LRP4, LRP8, LRRC1, LRRC32, LRRC39, LRRC42, LRRC8A, LSAMP, LSS, LTBR, LUC7L2, LUM, LYPD1, LYRM1, LZTS2, MACROD2, MADD, MAFB, MAGED4, MAGED4B, MAMDC2, MAN1A2, MAN2A1, MAN2C1, MANEA, MAP4K4, MAPK10, MAPK13, MARCH7, MARCH8, MASP1, MB, MB21D2, MBD1, MBOAT7, MC4R, MCM10, MVDM2, MDN1, MEAF6, MECP2, MED1, MED13L, MEDAG, MEF2D, MEGF6, MEIS2, MEMO1, MEPCE, MFGE8, MFN2, MIAT, MICAL2, MINPP1, MIR612, MKL1, MKLN1, MKNK2, MLLT4, MLLT10, MLST8, MMAB, MMP10, MMP24, MMS19, MMS22L, MN1, MORF4L1, MOXD1, MPPE1, MPZL1, MRPL3, MRPL39, MRPL45, MRPL55, MRPS28, MRVI1, MSANTD3, MSC, MSH2, MSH4, MSH6, MSL3, MSMO1, MSRB3, MTAP, MTERF3, MTERFD1, MTHFD1L, MTMR3, MTMR9, MTRR, MUM1, MVD, MVK, MXRA5, MYADM, MYB, MYCBP2, MYLK, MYO1D, MYO9B, MYOF, NA, NAA35, NAALADL2, NADK, NAE1, NAGS, NASP, NAV1, NAV2, NCOA1, NCOA3, NCOA4, NCSTN, NDNF, NEDD4, NELFA, NEO1, NEURL1B, NF2, NFASC, NFE2L1, NFX1, NGF, NGFR, NHLH1, NID1, NID2, NIPA1, NKX3-1, NLGN1, NLN, NOL10, NOMO3, NOTCH3, NOTUM, NOVA2, NOX4, NPEPPS, NRD1, NREP, NRG1, NRROS, NSUN4, NT5C2, NT5E, NTNG1, NUDT4, NUP153, NUP35, NUP50, NUPL, NUSAP1, OCLN, ODF2, OLR1, OS9, OSBPL3, OSBPL6, OSBPL10, OSMR, OXCT1, OXCT2, P4HA1, P4HB, PABPC1, PAIP2B, PAK4, PAPD4, PARD3, PARN, PARP14, PARP4, PARVB, PAX6, PBLD, PBX3, PCBP2, PCBP4, PCCB, PCDH10, PCDHGB3, PCGF3, PCM1, PCMTD2, PCNXL2, PCSK9, PDEC, PDE3A, PDE4A, PDE5A, PDE7A, PDGFD, PDGFRB, PDLIM7, PDS5B, PDXDC1, PDXDC2P, PEAR1, PELI1, PEPD, PEX5, PFKP, PHACTR3, PHF19, PHF8, PHRF1, PHTF2, PI4K2A, PIEZO1, PIGN, PIGU, PIK3C2B, PIK3CD, PIK3R1, PIKFYVE, PIM2, PITPNA, PITPNB, PITPNM1, PITPNM3, PLAU, PLEC, PLEK2, PLEKHA1, PLEKHA6, PLEKHB2, PLEKHH2, PLSCR1, PLSCR3, PLXNB2, PLXNC1, PMS1, PNISR, PODN, POLE3, POLN, POLR1A, POLR3D, POMT2, POSTN, POU2F1, PPAPDC1A, PPARA, PPARG, PPFIBP1, PPHLN1, PPIP5K1, PPIP5K2, PPM1E, PPPIR12A, PPP1R26, PPP3CA, PPP6R1, PPP6R2, PRKACB, PRKCA, PRKDC, PRKG1, PRMT1, PRNP, PRPF31, PRPH2, PRRG4, PRSS23, PRUNE2, PSMA4, PSMC1, PSMD6, PSMD6-AS2, PTCH1, PTGIS, PTK2B, PTPN14, PTX3, PUF60, PUS7, PVR, PXK, PXN, QKI, RAB23, RAB2B, RAB30, RAB34, RAB38, RAB44, RAD1, RAD9B, RAD23B, RAF1, RALB, RAP1A, RAP1GDS1, RAPGEF1, RARG, RARS, RARS2, RASIP1, RASSF8, RBBP8, RBCK1, RCOR3, RBFOX2, RBKS, RBM10, RCC1, RDX, RERE, RFTN1, RFWD2, RFX3-AS1, RGCC, RGL1, RGS10, RGS3, RIF1, RNF14, RNF19A, RNF130, RNF144A, RNF213, RNF38, RNFT1, ROR1, ROR2, RPA1, RPF2, RPL10, RPS10, RPS6KB2, RPS6KC1, RRBP1, RWDD4, SAMD4A, SAMD9, SAMD9L, SAR1A, SART3, SCAF4, SCAF8, SCARNA9, SCD, SCLT1, SCO1, SDCBP, SEC14L1, SEC22A, SEC24A, SEC24B, SEC61A, SENP6, SEPT9, SERGEF, SERPINE2, SF1, SF3B3, SGIP1, SGK3, SGMS1, SGOL2, SGPL1, SH2B3, SH3RF1, SH3YL1, SHROOM3, SIGLEC10, SKA2, SKIL, SKP1, SLC12A2, SLC24A3, SLC25A16, SLC25A17, SLC34A3, SLC35F3, SLC39A3, SLC39A10, SLC4A4, SLC4A11, SLC41A1, SLC44A2, SLC46A2, SLC6A15, SLC7A6, SLC7A8, SLC7A11, SLC9A3, SLIT3, SMARCA4, SMARCC2, SMC4, SMC6, SMCHD1, SMG1, SMG1P3, SMN2, SMOX, SMPD4, SMTN, SMYD3, SMYD5, SNAP23, SNED1, SNHG16, SNX7, SNX14, SNX24, SNX7, SOCS2, SOCS6, SOGA2, SON, SORBS2, SORCS1, SORCS2, SOS2, SOX7, SPATA18, SPATA20, SPATA5, SPATS2, SPDYA, SPEF2, SPG20, SPIDR, SPINK5, SPRED2, SPRYD7, SQLE, SQRDL, SQSTM1, SRCAP, SREBF1, SREK1, SRGAP1, SRRM1, SRSF3, SSBP1, STAC2, STARD4, STAT1, STAT3, STAT4, STAU1, STC2, STEAP2, STK32B, STRAD8, STRIP1, STRN3, STRN4, STS, STX16, STXBP4, STXBP6, SULF1, SUPT20H, SVEP1, SYNE1, SYNE2, SYNGR2, SYNPO, SYNPO2, SYNPO2L, SYT15, SYTL2, TACC1, TAF2, TAGLN3, TANC2, TANGO6, TARBP1, TARS, TASP1, TBC1D15, TBCA, TBL1XR1, TBL2, TCF12, TCF4, TCF7L2, TEKT4P2, TENC1, TENM2, TEP1, TET1, TET3, TEX21P, TFCP2, TGFA, TGFB2, TGFB3, TGFB1, TGFBR1, TGFBRAP1, TGM2, THADA, THAP4, THBS2, THRB, TIAM1, TIMP2, TJAP1, TJP2, TLE3, TLK1, TMC3, TMEM67, TMEM102, TMEM119, TMEM134, TMEM154, TMEM189-UBE2V1, TMEM214, TMEM256-PLSCR3, TMEM47, TMEM50B, TMEM63A, TMX3, TNC, TNFAIP3, TNFAIP8L3, TNFRSF12A, TNFRSF14, TNIP1, TNKS1BP1, TNPO3, TNRC18P1, TNRC6A, TNS1, TNS3, TNXB, TOE1, TOMM40, TOMM5, TOPORS, TP53AIP1, TP531NP1, TPRG1, TRAF3, TRAK1, TRAPPC12, TRIB1, TRIM2, TRIM23, TRIM26, TRIM28, TRIM65, TRIM66, TRMT1L, TRPC4, TRPS1, TSC2, TSHZ1, TSHZ2, TSPAN11, TSPAN18, TSPAN2, TSPAN7, TSSK3, TTC7A, TTC7B, TUBB2C, TUBB3, TUBE1, TXNIP, TXNL1, TXNL4B, TXNRD1, TYW5, U2SURP, UBAP2L, UBE2D3, UBE2G2, UBE2L3, UBE2V1, UBN2, UBQLN4, UCHL5, UHMK1, UHRF1BP1L, UNC13B, UNC5B, URGCP, URGCP-MRPS24, USP19, USP7, USP27X, UVRAG, VANGL1, VARS2, VAV2, VCL, VDAC2, VIM-AS1, VIPAS39, VPS13A, VPS29, VPS41, VPS51, VSTM2L, VWA8, VWF, WDR19, WDR27, WDR37, WDR48, WDR90, WDR91, WHSC2, WIPF1, WISP1, WNK1, WNT5B, WNT10B, WSB1, WWTR1, XDH, XIAP, XRN2, YAP1, YDJC, YES1, YPEL5, YTHDF3, Z24749, ZAK, ZBTB10, ZBTB24, ZBTB26, ZBTB7A, ZC3H12C, ZC3H14, ZC3H18, ZCCHC5, ZCCHC8, ZCCHC11, ZEB1, ZEB2, ZFAND1, ZFAND5, ZFP82, ZHX3, ZMIZ1, ZMIZ1-AS1, ZMIZ2, ZMYM2, ZNF12, ZNF138, ZNF148, ZNF208, ZNF212, ZNF219, ZNF227, ZNF232, ZNF24, ZNF268, ZNF28, ZNF280D, ZNF281, ZNF335, ZNF350, ZNF37A, ZNF37BP, ZNF395, ZNF426, ZNF431, ZNF583, ZNF618, ZNF621, ZNF652, ZNF655, ZNF660, ZNF674, ZNF680, ZNF730, ZNF74, ZNF764, ZNF777, ZNF778, ZNF780A, ZNF7804A, ZNF79, ZNF827, ZNF836, ZNF837, ZNF839, ZNF91 and ZSCAN25.

In another specific aspect described herein, the gene is, or the RNA transcript is transcribed from a gene that is selected from: ABCA1, ABCB7, ABCC1, ABHD10, ABL2, ABLIM3, ACACA, ACADVL, ACAT2, ADAM12, ADAM15, ADAM17, ADAM33, AFF2, AGK, AGPAT3, AGPS, AHCYL2, AHDC1, AHRR, AJUBA, AK021888, AK310472, AKAP1, AKAP9, AKNA, ALCAM, ALDH4A1, AMPD2, ANK2, ANKFY1, ANKHD1-EIF4EBP3, ANKRD17, ANKS6, ANP32A, ANXA11, ANXA6, AP2B1, APAF1, APLP2, APP, APPL2, APTX, ARHGAP22, ARID1A, ARID2, ARMCX3, ASAP1, ASL, ASNS, ASPH, ATAD2B, ATF7IP, ATG9A, ATMIN, ATP2C1, ATXN3, AURKA, AXIN1, B4GALT2, BACE1, BAG2, BASP1, BC033281, BCAR3, BEND6, BICD1, BIN1, BNC1, BRD2, BRPF1, BSCL2, BTBD10, BZW1, C11orf30, C11orf73, C17orf76-AS1, C4orf27, C5orf24, C6orf48, C9orf69, CAB39, CALU, CAMKK1, CAPNS1, CASC3, CASP8AP2, CAV1, CCAR1, CCDC77, CCDC88A, CCDC92, CCT6A, CD276, CD46, CDC25B, CDC40, CDC42BPA, CDCA7, CDH11, CDH13, CDK11B, CDK16, CDKAL1, CEP68, CFLAR, CHD8, CIZ1, CLIC1, CLK4, CNOT1, COG1, COL12A1, COL1A1, COL6A1, COPS7B, CPEB2, CREB5, CRLS1, CRTAP, CSDE1, CSNK1A1, CTDSP2, CTNND1, CUL2, CUL4A, CUX1, CYB5B, CYBRD1, CYP51A1, DAB2, DACT1, DARS, DAXX, DCAF10, DCAF11, DCBLD2, DCUN1D4, DDAH1, DDAH2, DDHD2, DDR1, DDX39B, DDX42, DENND1A, DENND1B, DENND5A, DGCR2, DGKA, DHCR24, DHCR7, DHFR, DHX9, DIAPH1, DIAPH3, DIS3L, DKFZp434M1735, DKK3, DLC1, DNM2, DOCK1, DPP8, DSEL, DST, DSTN, EBF1, EEA1, EEF1A1, EFCAB14, EGR1, EHMT2, EIF2B3, EIF4G1, EIF4G2, EIF4G3, ELF2, ENG, ENPP2, ENSA, EPN1, EPT1, ERC1, ERGIC3, ETV5, EXO1, EXTL2, EYA3, FADS1, FADS2, FAF1, FAM111A, FAM198B, FAM219A, FAM219B, FAM3C, FAM65A, FBXO10, FBXO18, FBXO31, FBXO34, FBXO9, FDFT1, FDPS, FER, FEZ1, FGD5-AS1, FGFRL1, FHOD3, FLII, FLNB, FN1, FNBP1, FOCAD, FOS, FOSB, FOSL1, FOXK1, FOXM1, FUS, FYN, GABPB1, GALC, GALNT1, GAS7, GBA2, GCFC2, GGCT, GHDC, GIGYF2, GJC1, GMIP, GNA13, GNAS, GNL3L, GOLGA2, GOLGA4, GOLGB1, GORASP1, GPR1, GPR89A, GPSM2, GREM1, GRK6, GSE1, GTF2H2B, HAS2, HAT1, HAUS3, HAUS6, HDAC7, HEG1, HLA-A, HLA-E, HLTF, HMGA1, HMGB1, HMGCR, HMGCS1, HMOX1, HNRNPR, HNRNPUL1, HP1BP3, HRH1, HSD17B12, HSD17B4, HTT, IARS, IDH1, IDI1, IGF2BP2, IL6ST, INHBA, INSIG1, IQCE, ITGAV, ITGB5, ITM2C, ITSN1, KANSL3, KCNK2, KIAA1033, KIAA1143, KIAA1199, KIAA1522, KIAA1524, KIAA1549, KIAA1715, KIF14, KIF2A, KIF3A, KLC1, KLC2, KLF6, KLHL7, KRT18, KRT19, KRT34, KRTAP2-3, LAMA2, LAMB1, LARP4, LARP7, LATS2, LDLR, LEMD3, LGALS8, LIMS1, LINC00341, LINC00657, LMAN2L, LMO7, LONP1, LOX, LRCH4, LRIG1, LRP8, LRRC8A, LSS, LTBR, LUC7L2, LZTS2, MADD, MAGED4, MAGED4B, MAN1A2, MAP4K4, MBD1, MBOAT7, MDM2, MED1, MEDAG, MEF2D, MEIS2, MEMO1, MEPCE, MFGE8, MICAL2, MINPP1, MKL1, MKLN1, MKNK2, MLLT4, MLST8, MMAB, MMS19, MMS22L, MPPE1, MPZL1, MRPL3, MSANTD3, MSC, MSH2, MSH6, MSL3, MSMO1, MSRB3, MTAP, MTERFD1, MTHFD1L, MTMR9, MTRR, MUM1, MVD, MVK, MYADM, MYLK, MYO1D, MYO9B, MYOF, NAA35, NADK, NASP, NAV1, NAV2, NCOA1, NCOA3, NCOA4, NCSTN, NELFA, NEO1, NEURL1B, NF2, NFE2L1, NFX1, NID1, NID2, NIPA1, NKX3-1, NOL10, NOMO3, NPEPPS, NRD1, NREP, NRG1, NSUN4, NT5C2, NT5E, NTNG1, NUDT4, NUP153, NUP35, NUP50, NUPL1, NUSAP1, ODF2, OS9, OSBPL6, OSMR, P4HA1, P4HB, PABPC1, PAK4, PAPD4, PARD3, PARN, PARP14, PARP4, PARVB, PCBP2, PCBP4, PCDHGB3, PCGF3, PCM1, PCMTD2, PCNXL2, PCSK9, PDE4A, PDE7A, PDLIM7, PDXDC1, PEPD, PEX5, PFKP, PHF19, PHF8, PHRF1, PHTF2, PI4K2A, PIEZO1, PIGU, PIK3C2B, PITPNA, PITPNB, PITPNM1, PLAU, PLEC, PLEKHB2, PLSCR3, PLXNB2, PLXNC1, PMS1, POLE3, POLR3D, POSTN, POU2F1, PPAPDC1A, PPARA, PPHLN1, PPIP5K1, PPP1R12A, PPP6R1, PPP6R2, PRKACB, PRKDC, PRMT1, PRNP, PRSS23, PSMA4, PSMC1, PSMD6, PTK2B, PTPN14, PUF60, PUS7, PVR, PXN, QKI, RAB23, RAB2B, RAB34, RAD1, RAD23B, RALB, RAP1A, RAP1GDS1, RARG, RASSF8, RBCK1, RBFOX2, RBM10, RCC1, RFTN1, RFWD2, RGS10, RGS3, RIF1, RNF14, RNF19A, RNF38, RNFT1, RPL10, RPS6KC1, RRBP1, RWDD4, SAMD9, SAMD9L, SAR1A, SART3, SCAF4, SCAF8, SCD, SCLT1, SCO1, SDCBP, SEC14L1, SEC22A, SEC24B, SEC61A1, SEPT9, SERPINE2, SF1, SGOL2, SH3RF1, SKIL, SLC25A17, SLC39A3, SLC41A1, SLC4A4, SLC7A6, SLC7A8, SMARCA4, SMARCC2, SMC4, SMC6, SMCHD1, SMG1, SMN2, SMPD4, SMYD3, SMYD5, SNAP23, SNHG16, SNX14, SOCS2, SON, SOS2, SPATA20, SPATS2, SPG20, SPRED2, SQLE, SQRDL, SQSTM1, SRCAP, SREBF1, SREK1, SRSF3, STARD4, STAT1, STAT3, STAU1, STC2, STEAP2, STRIP1, STRN3, STX16, SUPT20H, SYNE1, SYNE2, SYT15, SYTL2, TACC1, TAF2, TANC2, TARBP1, TARS, TBC1D15, TBL2, TCF7L2, TENC1, TENM2, TEP1, TET3, TFCP2, TGFB1, TGFBR1, TGFBRAP1, THADA, THAP4, THRB, TIMP2, TJP2, TLE3, TLK1, TMEM154, TMEM47, TMEM63A, TNC, TNFAIP3, TNFRSF12A, TNIP1, TNKS1BP1, TNPO3, TNS1, TNS3, TOE1, TOMM40, TOMM5, TOPORS, TP53INP1, TRAF3, TRAK1, TRAPPC12, TRIB1, TRIM2, TRIM23, TRIM26, TRIM28, TRIM65, TRMT1L, TRPS1, TSC2, TSHZ1, TSPAN2, TTC7A, TUBB2C, TUBB3, TXNL1, TXNRD1, U2SURP, UBAP2L, UBE2G2, UBE2V1, UBQLN4, UCHL5, UHMK1, UHRF1BP1L, UNC5B, USP19, USP7, VANGL1, VARS2, VCL, VIPAS39, VPS13A, VPS29, VPS51, VWA8, WDR19, WDR37, WDR48, WIPF1, WNT5B, WSB1, WWTR1, XIAP, XRN2, YAP1, YES1, YPEL5, YTHDF3, Z24749, ZAK, ZBTB10, ZBTB24, ZBTB7A, ZC3H12C, ZC3H14, ZC3H18, ZCCHC11, ZEB1, ZEB2, ZFAND1, ZFAND5, ZHX3, ZMIZ1, ZMYM2, ZNF12, ZNF148, ZNF219, ZNF227, ZNF24, ZNF268, ZNF28, ZNF281, ZNF335, ZNF37A, ZNF37BP, ZNF395, ZNF583, ZNF621, ZNF652, ZNF655, ZNF674, ZNF74, ZNF764, ZNF778, ZNF780A, ZNF827, ZNF839 and ZNF91.

In another specific aspect described herein, the gene is, or the RNA transcript is transcribed from a gene that is selected from: ABCB8, ANKRD36, APLP2, ARHGAP12, ARMCX6, ASAP1, ATG5, AXIN1, BIRC6, C1orf86, CDC42BPA, CLTA, DYRK1A, ERGIC3, FBXL6, FOXM1, GGCT, KAT6B, KDM6A, KIF3A, KMT2D, LARP7, LYRM1, MADD, MAN2C1, MRPL55, MYCBP2, MYO9B, PNISR, RAP1A, RAPGEF1, SENP6, SH3YL1, SLC25A17, SMN2, SREK1, STRN3, TAF2, TMEM134, VPS29, ZFAND1 and ZNF431.

In another specific aspect described herein, the gene is, or the RNA transcript is transcribed from a gene that is selected from: ABCB8, ANKRD36, ARHGAP12, ARMCX6, ATG5, BIRC6, C1orf86, CLTA, DYRK1A, FBXL6, KAT6B, KDM6A, KMT2D, LYRM1, MAN2C1, MRPL55, MYCBP2, PNISR, RAPGEF1, SENP6, SH3YL1, TMEM134 and ZNF431.

In another specific aspect described herein, the gene is, or the RNA transcript is transcribed from a gene that is selected from: ABCA10, ABCC1, ACTA2, ADAL, ADAM12, ADAMTS1, ADAMTS5, ADD1, ADGRG6, ADH6, ADHFE1, AFF2, AFF3, AGK, AGPS, AKAP3, ANK1, ANK2, ANK3, ANKRD33B, ANXA11, ANXA6, AP4B1-AS1, ARHGEF16, ARID5B, ARL9, ARMCX3, ASAP1, ASIC1, ATP2A3, B3GALT2, B3GNT6, BCL2L15, BCYRN1, BIN3-IT1, BIRC3, BTG2, C10orf54, C11orf70, C11orf73, C11orf94, C12orf56, C19orf47, C3, C4orf27, C7orf31, C8orf34, CA13, CA3, CACNA2D2, CACNB1, CADM1, CAND2, CCDC79, CCER2, CCNF, CDCA7, CDKAL1, CELSR1, CEMIP, CEP170, CFH, CIITA, CLDN23, CMAHP, CNGA4, CNTD1, COL11A, COL12A1, COL4A, COL15A1, COL5A1, COL5A3, COL6A6, COL8A1, COLEC12, COMP, CPA4, CPQ, CRISPLD2, CRLF1, CRYL1, CUX1, CYB5B, CYB5R2, CYGB, CYP1B1, DCLK1, DCN, DDIT4L, DDX42, DDX50, DEGS1, DENND1A, DENND5A, DEPTOR, DFNB59, DGKA, DHFR, DIAPH3, DIRAS3, DIS3L, DLG5, DNAH8, DNAJC27, DOCK1, DOCK11, DYNC1I1, DZIP1L, EBF1, EFEMP1, EGR3, EIF2B3, ELN, ELP4, EMX2OS, ENPP1, ERCC8, ESM1, EVC2, F2R, FAM160A1, FAM198B, FAM20A, FAM46B, FAM65B, FAP, FARP1, FBLN2, FBN2, FBXO9, FCHO1, FER, FGFR2, FGL2, FLT1, FRAS1, FSCN2, GAL3ST4, GALC, GALNT15, GATA6, GBGT1, GCNT1, GDF6, GNAQ, GOLGB1, GPR183, GPR50, GPRC5A, GPRC5B, GRTP1, GUCA1B, GXYLT1, HAPLN1, HAPLN2, HAS3, HAVCR2, HDAC5, HECTD2-AS1, HEPH, HEY1, HLTF, HMGN3-AS1, HMOX1, HOOK3, HSD17B12, HSPA1L, HTATIP2, HTT, IGDCC4, IGF2R, IGFBP3, IL16, INA, INTU, IQCG, ITGAI1, ITGA8, ITGB8, ITIH1, ITPKA, KCNS1, KCNS2, KDM6A, KDSR, KIAA1456, KIAA1462, KIAA1524, KIAA1715, KIAA1755, KIT, KLF17, KLRG1, KRT7, KRTAP1-1, KRTAP1-5, L3MBTL2, LAMB2P1, LGI2, LGR4, LHX9, LINC00472, LINC00570, LINC00578, LINC00607, LINC00678, LINC00702, LINC00886, LINC00961, LINC01011, LINC0118, LINC01204, LMOD1, LRBA, LRP4, LRRC32, LRRC39, LSAMP, LUM, LYPD1, LYRM1, MAFB, MAMDC2, MAN1A2, MAN2A1, MAPK13, MASP1, MB, MC4R, MEDAG, MEGF6, MEMO1, MIAT, MIR612, MLLT10, MMP10, MMP24, MMS19, MN1, MOXD1, MRVI1, MSH4, MTERF3, MXRA5, MYO1D, NA, NAALADL2, NAE1, NAGS, NDNF, NEURL1B, NGFR, NHLH1, NLN, NOTCH3, NOTUM, NOVA2, NOX4, NRROS, NTNG1, OCLN, OLR1, OSBPL10, OXCT2, PAIP2B, PAPD4, PBLD, PCM1, PDE1C, PDE5A, PDGFD, PDGFRB, PDS5B, PDXDC1, PEAR1, PEPD, PHACTR3, PI4K2B, PIK3R1, PIM2, PITPNM3, PLAU, PLEK2, PLEKHA6, PLEKHH2, PLXNC1, PMS1, PODN, POLN, POLR1A, POSTN, PPM1E, PPP3CA, PRKCA, PRKDC, PRKG1, PRPH2, PRRG4, PRUNE2, PSMD6-AS2, PTGIS, PTX3, RAB30, RAB38, RAB44, RAD9B, RARS, RBBP8, RBKS, RCC1, RDX, RFWD2, RFX3-AS1, RGCC, RNFT1, ROR1, ROR2, RWDD4, SCARNA9, SCO1, SEC22A, SHROOM3, SIGLEC10, SLC24A3, SLC35F3, SLC39A10, SLC46A2, SLC4A11, SLC6A15, SLC7A11, SLC9A3, SLIT3, SMG1P3, SMTN, SMYD3, SNED1, SORBS2, SORCS2, SOX7, SPDYA, SPEF2, SQRDL, STAC2, STAT1, STAT4, STEAP2, STK32B, STRN4, STS, STXBP6, SULF1, SVEP1, SYNGR2, SYNPO, SYNPO2, SYNPO2L, TAGLN3, TANGO6, TARBP1, TEX21P, TGFA, TGFB2, TGFB3, TGM2, THADA, THBS2, THRB, TMEM102, TMEM119, TMEM256-PLSCR3, TMEM50B, TNC, TNFAIP8L3, TNFRSF14, TNRC18P1, TNS3, TNXB, TP53AIP1, TPRG1, TRAF3, TRIM66, TRPC4, TSHZ2, TSPAN11, TSPAN18, TSPAN7, TSSK3, TXNIP, UNC5B, USP27X, UVRAG, VIM-AS1, VPS41, VSTM2L, VWA8, VWF, WDR91, WISP1, WNT10B, XRN2, YDJC, ZBTB26, ZCCHC5, ZFP82, ZMIZ1-AS1, ZNF212, ZNF350, ZNF660, ZNF79 and ZNF837.

In another specific aspect described herein, the gene is, or the RNA transcript is transcribed from a gene that is selected from: ABCA10, ACTA2, ADAL, ADAMTS1, ADAMTS5, ADD1, ADGRG6, ADH6, ADHFE1, AFF3, AKAP3, ANK1, ANK3, ANKRD33B, AP4B1-AS1, ARHGEF16, ARID5B, ARL9, ASIC1, ATP2A3, B3GALT2, B3GNT6, BCL2L15, BCYRN1, BIN3-IT1, BIRC3, BTG2, C10orf54, C11orf70, C11orf94, C12orf56, C19orf47, C3, C7orf31, C8orf34, CA13, CA3, CACNA2D2, CACNB1, CADM1, CAND2, CCDC79, CCER2, CCNF, CELSR1, CEMIP, CEP170, CFH, CIITA, CLDN23, CMAHP, CNGA4, CNTD1, COL11A1, COL4A1, COL15A1, COL5A1, COL5A3, COL6A6, COL8A1, COLEC12, COMP, CPA4, CPQ, CRISPLD2, CRLF1, CRYL1, CYB5R2, CYGB, CYP1B1, DCLK1, DCN, DDIT4L, DDX50, DEGS1, DEPTOR, DFNB59, DIRAS3, DLG5, DNAH8, DNAJC27, DOCK11, DYNC1I1, DZIP1L, EFEMP1, EGR3, ELN, ELP4, EMX2OS, ENPP1, ERCC8, ESM1, EVC2, F2R, FAM160A1, FAM20A, FAM46B, FAM65B, FAP, FARP1, FBLN2, FBN2, FBXO9, FCHO1, FGFR2, FGL2, FLT1, FRAS1, FSCN2, GAL3ST4, GALNT15, GATA6, GBGT1, GCNT1, GDF6, GNAQ, GPR183, GPR50, GPRC5A, GPRC5B, GRTP1, GUCA1B, GXYLT1, HAPLN1, HAPLN2, HAS3, HAVCR2, HDAC5, HECTD2-AS1, HEPH, HEY1, HMGN3-AS1, HOOK3, HSPA1L, HTATIP2, IGDCC4, IGF2R, IGFBP3, IL16, INA, INTU, IQCG, ITGA11, ITGA8, ITGB8, ITIH1, ITPKA, KCNS1, KCNS2, KDM6A, KDSR, KIAA1456, KIAA1462, KIAA1755, KIT, KLF17, KLRG1, KRT7, KRTAP1-1, KRTAP1-5, L3MBTL2, LAMB2P1, LGI2, LGR4, LHX9, LINC00472, LINC00570, LINC00578, LINC00607, LINC00678, LINC00702, LINC00886, LINC00961, LINC01011, LINC01118, LINC01204, LMOD1, LRBA, LRP4, LRRC32, LRRC39, LSAMP, LUM, LYPD1, MAFB, MAMDC2, MAN2A1, MAPK13, MASP1, MB, MC4R, MEGF6, MIAT, MIR612, MLLT10, MMP10, MMP24, MN1, MOXD1, MRVI1, MSH4, MTERF3, MXRA5, NA, NAALADL2, NAE1, NAGS, NDNF, NGFR, NHLH1, NLN, NOTCH3, NOTUM, NOVA2, NOX4, NRROS, OCLN, OLR1, OSBPL10, OXCT2, PAIP2B, PBLD, PDE1C, PDE5A, PDGFD, PDGFRB, PDS5B, PEAR1, PHACTR3, PI4K2B, PIK3R1, PIM2, PITPNM3, PLEK2, PLEKHA6, PLEKHH2, PODN, POLN, POLR1A, PPM1E, PPP3CA, PRKCA, PRKG1, PRPH2, PRRG4, PRUNE2, PSMD6-AS2, PTGIS, PTX3, RAB30, RAB38, RAB44, RAD9B, RARS, RBBP8, RBKS, RDX, RFX3-AS1, RGCC, ROR1, ROR2, SCARNA9, SHROOM3, SIGLEC10, SLC24A3, SLC35F3, SLC39A10, SLC46A2, SLC4A11, SLC6A15, SLC7A11, SLC9A3, SLIT3, SMG1P3, SMTN, SNED1, SORBS2, SORCS2, SOX7, SPDYA, SPEF2, STAC2, STAT4, STK32B, STRN4, STS, STXBP6, SULF1, SVEP1, SYNGR2, SYNPO, SYNPO2, SYNPO2L, TAGLN3, TANGO6, TEX21P, TGFA, TGFB2, TGFB3, TGM2, THBS2, TMEM102, TMEM119, TMEM256-PLSCR3, TMEM50B, TNFAIP8L3, TNFRSF14, TNRC18P1, TNXB, TP53AIP1, TPRG1, TRIM66, TRPC4, TSHZ2, TSPAN11, TSPAN18, TSPAN7, TSSK3, TXNIP, USP27X, UVRAG, VIM-AS1, VPS41, VSTM2L, VWF, WDR91, WISP1, WNT10B, YDJC, ZBTB26, ZCCHC5, ZFP82, ZMIZ1-AS1, ZNF212, ZNF350, ZNF660, ZNF79 and ZNF837.

In another specific aspect described herein, the gene is, or the RNA transcript is transcribed from a gene that is selected from: ABCB8, ABCC3, ADAM17, ADCY3, AGPAT4, ANKRA2, ANXA11, APIP, APLP2, ARHGAP1, ARL15, ASAP1, ASPH, ATAD2B, ATXN1, AXIN1, BECN1, BHMT2, BICD1, BTN3A1, C11orf30, C11orf73, C12orf4, C14orf132, C8orf44, C8orf44-SGK3, C8orf88, CASC3, CASP7, CCDC122, CDH13, CECR7, CENPI, CEP112, CEP192, CHEK1, CMAHP, CNRIP1, COPS7B, CPSF4, CRISPLD2, CRYBG3, CSNK1E, CSNK1G1, DAGLB, DCAF17, DCUN1D4, DDX42, DENND1A, DENND5A, DGKA, DHFR, DIAPH3, DLGAP4, DNAJC13, DNMBP, DOCK1, DYRK1A, EIF2B3, ENAH, ENOX1, EP300, ERC1, ERCC1, ERGIC3, ERLIN2, ERRFI1, EVC, FAF1, FAIM, FAM126A, FAM13A, FAM162A, FAM174A, FAM198B, FBN2, FER, FHOD3, FOCAD, GALC, GCFC2, GGACT, GGCT, GLCE, GOLGA4, GOLGB1, GPSM2, GULP1, GXYLT1, HAT1, HDX, HLTF, HMGA2, HNMT, HPS1, HSD17B12, HSD17B4, HTT, IFT57, INPP5K, IVD, KDM6A, KIAA1524, KIAA1715, LETM2, LOC400927, LRRC42, LUC7L3, LYRM1, MADD, MB21D2, MCM10, MED13L, MEDAG, MEMO1, MFN2, MMS19, MRPL45, MRPS28, MTERF3, MYCBP2, MYLK, MYOF, NGF, NREP, NSUN4, NT5C2, OSMR, OXCT1, PAPD4, PCM1, PDE7A, PDS5B, PDXDC1, PIGN, PIK3CD, PIK3R1, PIKFYVE, PITPNB, PLEKHA1, PLSCR1, PMS1, POMT2, PPARG, PPHLN1, PPIP5K2, PPP1R26, PRPF31, PRSS23, PRUNE2, PSMA4, PXK, RAF1, RAP1A, RAPGEF1, RARS2, RBKS, RERE, RFWD2, RNFT1, RPA1, RPS10, RPS6KB2, SAMD4A, SAR1A, SCO1, SEC24A, SENP6, SERGEF, SGK3, SH3YL1, SKA2, SLC12A2, SLC25A17, SLC44A2, SMYD3, SNAP23, SNHG16, SNX7, SOS2, SPATA18, SPATA5, SPIDR, SPRYD7, SRGAP1, SRRM1, STAT1, STRN3, STXBP6, SUPT20H, TAF2, TASP1, TBC1D15, TCF12, TCF4, TIAM1, TJP2, TMC3, TMEM189-UBE2V1, TMEM214, TNRC6A, TNS3, TOE1, TRAF3, TRIM65, TSPAN2, TTC7B, TUBE1, TYW5, UBAP2L, UBE2V1, URGCP, VAV2, VPS29, WDR27, WDR37, WDR91, WNK1, XRN2, ZCCHC8, ZFP82, ZNF138, ZNF232, ZNF37BP and ZNF680.

In another specific aspect described herein, the gene is, or the RNA transcript is transcribed from a gene that is selected from: ABCB8, ABCC3, ADCY3, AGPAT4, ANKRA2, APIP, ARHGAP1, ARL15, ATXN1, BECN1, BHMT2, BTN3A1, C12orf4, C14orf132, C8orf44, C8orf44-SGK3, C8orf88, CASP7, CCDC122, CECR7, CENPI, CEP112, CEP192, CHEK1, CMAHP, CNRIP1, CPSF4, CRISPLD2, CRYBG3, CSNK1E, CSNK1G1, DAGLB, DCAF17, DLGAP4, DNAJC13, DNMBP, DYRK1A, ENAH, EP300, ERCC1, ERLIN2, ERRFI1, EVC, FAIM, FAM126A, FAM13A, FAM162A, FAM174A, FBN2, GGACT, GLCE, GULP1, GXYLT1, HDX, HMGA2, HNMT, HPS1, IFT57, INPP5K, IVD, KDM6A, LETM2, LOC400927, LRRC42, LYRM1, MB21D2, MCM10, MED13L, MFN2, MRPL45, MRPS28, MTERF3, MYCBP2, NGF, OXCT1, PDS5B, PIGN, PIK3CD, PIK3R1, PIKFYVE, PLEKHA1, PLSCR1, POMT2, PPARG, PPIP5K2, PPP1R26, PRPF31, PRUNE2, PXK, RAF1, RAPGEF1, RARS2, RBKS, RERE, RPA1, RPS10, RPS6KB2, SAMD4A, SEC24A, SENP6, SERGEF, SGK3, SH3YL1, SKA2, SLC12A2, SLC44A2, SNX7, SPATA18, SPATA5, SPIDR, SPRYD7, SRGAP1, SRRM1, STXBP6, TASP1, TCF12, TCF4, TIAM1, TMC3, TMEM189-UBE2V1, TMEM214, TNRC6A, TTC7B, TUBE1, TYW5, URGCP, VAV2, WDR27, WDR91, WNK1, ZCCHC8, ZFP82, ZNF138, ZNF232 and ZNF680.

In another specific aspect described herein, the gene is, or the RNA transcript is transcribed from a gene that is selected from: ABHD10, ADAL, ADAM17, ADAM23, ADAMTS19, AGPAT4, AGPS, AKAP8L, AKT1, ANKRD13C, ANXA11, APIP, APPL2, ARHGAP1, ARHGAP5, ARL15, ARL5B, ARSJ, ASAP1, ATF6, BECN1, BHMT2, BIN3, BNC2, BTBD10, C1QTNF9B-AS1, C1orf27, C11orf30, C11orf73, C11orf76, C12orf4, C2orf47, CACNB1, CACNB4, CADM2, CCNL2, CDH18, CENPI, CEP162, CEP170, CEP192, CEP57, CHEK1, CHRM2, CMAHP, CMSS1, CNOT7, CNRIP1, CNTN1, COPS7B, CRISPLD2, CRYBG3, CUX1, DAAM1, DCAF17, DCUN1D4, DDX42, DENND1A, DENND4A, DENND5A, DET1, DGK1, DHFR, DIAPH3, DLG5, DMXL1, DNAJA4, DNMBP, DYRK1A, DZIP1L, ELMO2, ENAH, ENOX1, EP300, ERC1, ERC2, EVC, EXOC3, EXOC6B, FAM162A, FAM174A, FAM195B, FAM208B, FAM49B, FAM69B, FBN2, FBXL16, FBXO9, FGD4, FHOD3, GALC, GBP1, GLCE, GNG12, GOLGB1, GTSF1, GXYLT1, HDAC5, HDX, HMGXB4, HOXB3, HSD17B4, HTT, IFT57, IKBKAP, INO80, IPP4B, INVS, ITCH, IVD, KDM6A, KDSR, KIAA1524, KIAA1715, KIDINS220, KIF21A, L3MBTL2, LGALS3, LINCR-0002, LINGO2, LOC400927, LPHN1, LRRC1, LRRC42, LYRM1, MACROD2, MANEA, MAPK10, MARCH7, MARCH8, MDN1, MEAF6, MEMO1, MFN2, MLLT10, MMS19, MORF4L1, MRPL39, MRPL45, MRPS28, MTMR3, MYB, MYCBP2, MYLK, NEDD4, NFASC, NGF, NIPA1, NLGN1, NLN, NREP, NSUN4, NUPL1, OSBPL3, PAPD4, PBX3, PCDH10, PDE3A, PDE7A, PDXDC1, PDXDC2P, PELI1, PIGN, PITPNB, PMS1, PNISR, POMT2, PPARG, PPFIBP1, PRPF31, PSMA4, PXK, RAB23, RAF1, RAPGEF1, RASIP1, RBBP8, RCOR3, RERE, RGL1, RNF130, RNF144A, RNF213, RPF2, RPS10, SAMD4A, SCO1, SENP6, SF3B3, SGIP1, SGMS1, SGPL1, SH2B3, SKP1, SLC12A2, SLC25A16, SLC25A17, SMOX, SNAP23, SNX24, SNX7, SOCS6, SOGA2, SORCS1, SPIDR, SPRYD7, SREK1, SSBP1, STRAD8, STXBP4, STXBP6, SUPT20H, TAF2, TARBP1, TASP1, TBCA, TBL1XR1, TCF4, TEKT4P2, TET1, TIAM1, TJAP1, TJP2, TMEM214, TMX3, TNRC6A, TRAF3, TRIM65, TSPAN7, TXNL4B, UBE2D3, UBE2L3, UBN2, UNC3B, URGCP-MRPS24, UVRAG, VDAC2, WDR27, WDR90, WHSC2, WNK1, XRN2, ZFP82, ZMIZ2, ZNF138, ZNF208, ZNF212, ZNF280D, ZNF350, ZNF37BP, ZNF426, ZNF618, ZNF680, ZNF730, ZNF777, ZNF7804A, ZNF836 and ZSCAN25.

In another specific aspect described herein, the gene is, or the RNA transcript is transcribed from a gene that is selected from: APOA2, ASAP1, BRCA1, BRCA2, CDKN1C, CRX, CTRC, DENND5A, DIAPH3, DMD, DNAH11, EIF2B3, GALC, HPS1, HTT, IKBKAP, KIAA1524, LMNA, MECP2, PAPD4, PAX6, PCCB, PITPNB, PTCH1, SLC34A3, SMN2, SPINK5, SREK1, TMEM67, VWF, XDH and XRN2.

In another specific aspect described herein, the gene is, or the RNA transcript is transcribed from a gene that is selected from: ABCA1, ABCA10, ABCB7, ABCB8, ABCC1, ABCC3, ABL2, ABLIM3, ACACA, ACADVL, ACAT2, ACTA2, ADAL, ADAM15, ADAM17, ADAM23, ADAM33, ADAMTS1, ADAMTS19, ADCY3, ADD1, ADGRG6, ADH6, ADHFE1, AFF2, AFF3, AGK, AGPAT3, AGPAT4, AGPS, AHCYL2, AHDC1, AHRR, AJUBA, AK021888, AK310472, AKAP1, AKAP3, AKAP8L, AKAP9, AKNA, ALCAM, ALDH4A1, AMPD2, ANK1, ANK2, ANK3, ANKFY1, ANKHD1-EIF4EBP3, ANKRA2, ANKRD13C, ANKRD17, ANKRD33B, ANKRD36, ANKS6, ANP32A, ANXA6, AP2B1, AP4B1-AS1, APAF1, APIP, APOA2, APP, APTX, ARHGAP1, ARHGAP12, ARHGAP22, ARHGAP5, ARHGEF16, ARID1A, ARID2, ARID5B, ARL9, ARL15, ARL5B, ARMCX3, ARSJ, ASAP1, ASIC1, ASL, ASNS, ASPH, ATAD2B, ATF6, ATF7IP, ATG9A, ATMIN, ATP2A3, ATP2C1, ATXN1, ATXN3, AURKA, B3GALT2, B3GNT6, B4GALT2, BACE1, BAG2, BASP1, BC033281, BCAR3, BCL2L15, BCYRN1, BECN1, BEND6, BHMT2, BICD1, BIN1, BIN3, BIN3-IT1, BIRC3, BIRC6, BNC1, BNC2, BRCA1, BRCA2, BRD2, BRPF1, BSCL2, BTBD10, BTG2, BTN3A1, BZW1, C1QTNF9B-AS1, C1orf27, C1orf86, C10orf54, C11orf30, C11orf70, C11orf73, C11orf76, C11orf94, C12orf4, C12orf56, C14orf132, C17orf76-AS1, C19orf47, C2orf47, C3, C4orf27, C5orf24, C6orf48, C7orf31, C8orf34, C8orf44, C8orf44-SGK3, C8orf88, C9orf69, CA13, CA3, CAB39, CACNA2D2, CACNB1, CACNB4, CADM1, CADM2, CALU, CAMKK1, CAND2, CAPNS1, CASC3, CASP7, CASP8AP2, CAV1, CCAR1, CCDC77, CCDC79, CCDC88A, CCDC92, CCDC122, CCER2, CCNF, CCNL2, CCT6A, CD276, CD46, CDC25B, CDC40, CDC42BPA, CDCA7, CDH11, CDH13, CDH18, CDK11B, CDK16, CDKAL1, CDKN1C, CECR7, CELSR1, CEMIP, CENPI, CEP112, CEP162, CEP170, CEP192, CEP68, CFH, CFLAR, CHD8, CHEK1, CHRM2, CIITA, CIZ1, CLDN23, CLIC1, CLK4, CLTA, CMAHP, CNGA4, CNOT1, CNRIP1, CNTD1, CMSS1, CNOT7, CNRIP1, CNTN1, COG1, COL1A1, COL11A1, COL12A1, COL4A1, COL15A1, COL5A1, COL5A3, COL6A1, COL6A6, COL8A1, COLEC12, COMP, COPS7B, CPA4, CPEB2, CPQ, CPSF4, CREB5, CRISPLD2, CRLF1, CRLS1, CRTAP, CRX, CRYBG3, CRYL1, CSDE1, CSNK1A1, CSNK1E, CSNK1G1, CTDSP2, CTNND1, CTRC, CUL2, CUL4A, CUX1, CYB5B, CYB5R2, CYBRD1, CYGB, CYP1B1, CYP51A1, DAAM1, DAB2, DACT1, DAGLB, DARS, DAXX, DCAF10, DCAF11, DCAF17, DCBLD2, DCLK1, DCN, DCUN1D4, DDAH1, DDAH2, DDHD2, DDIT4L, DDR1, DDX39B, DDX42, DDX50, DEGS1, DENND1A, DENND1B, DENND4A, DENND5A, DEPTOR, DET1, DFNB59, DGCR2, DGK1, DGKA, DHCR24, DHCR7, DHFR, DHX9, DIAPH1, DIAPH3, DIRAS3, DIS3L, DKFZp434M1735, DKK3, DLC1, DLG5, DMD, DMXL1, DNAH8, DNAH11, DNAJA4, DNAJC13, DNAJC27, DNM2, DNMBP, DOCK1, DOCK11, DPP8, DSEL, DST, DSTN, DYNC1I1, DYRK1A, DZIP1L, EBF1, EEA1, EEFIA1, EFCAB14, EFEMP1, EGR1, EGR3, EHMT2, EIF2B3, EIF4G1, EIF4G2, EIF4G3, ELF2, ELMO2, ELN, ELP4, EMX2OS, ENAH, ENG, ENOX1, ENPP1, ENPP2, ENSA, EP300, EPT1, ERC1, ERC2, ERCC1, ERCC8, ERLIN2, ERRFI1, ESM1, ETV5, EVC, EVC2, EXO1, EXOC3, EXOC6B, EXTL2, EYA3, F2R, FADS1, FADS2, FAF1, FAIM, FAM111A, FAM126A, FAM13A, FAM160A1, FAM162A, FAM174A, FAM195B, FAM198B, FAM20A, FAM208B, FAM219A, FAM219B, FAM3C, FAM46B, FAM49B, FAM65A, FAM65B, FAM69B, FAP, FARP1, FBLN2, FBN2, FBXL16, FBXL6, FBXO9, FBXO10, FBXO18, FBXO31, FBXO34, FBXO9, FCHO1, FDFT1, FDPS, FER, FEZ1, FGD4, FGD5-AS1, FGFR2, FGFRL1, FGL2, FHOD3, FLII, FLNB, FLT1, FN1, FNBP1, FOCAD, FOS, FOSB, FOSL1, FOXK1, FRAS1, FSCN2, FUS, FYN, GABPB1, GAL3ST4, GALC, GALNT1, GALNT15, GAS7, GATA6, GBA2, GBGT1, GBP1, GCFC2, GLCE, GCNT1, GDF6, GGACT, GHDC, GIGYF2, GJC1, GLCE, GMIP, GNA13, GNAQ, GNAS, GNG12, GNL3L, GOLGA2, GOLGA4, GOLGB1, GORASP1, GPR1, GPR183, GPR50, GPR89A, GPRC5A, GPRC5B, GPSM2, GREM1, GRK6, GRTP1, GSE1, GTF2H2B, GTSF1, GUCA1B, GULP1, GXYLT1, HAPLN1, HAPLN2, HAS2, HAS3, HAT1, HAUS3, HAUS6, HAVCR2, HDAC5, HDAC7, HDX, HECTD2-AS1, HEG1, HEPH, HEY1, HLA-A, HLA-E, HLTF, HMGA1, HMGA2, HMGB1, HMGCR, HMGN3-AS1, HMGCS1, HMGXB4, HOOK3, HOXB3, HMOX1, HNMT, HNRNPR, HNRNPUL1, HP1BP3, HPS1, HRH1, HSD17B12, HSPA1L, HTATIP2, HTT, IARS, IDH1, IDI1, IFT57, IGDCC4, IGF2BP2, IGF2R, IGFBP3, IKBKAP, I1L16, IL6ST, INA, INHBA, INO80, IPP4B, INPP5K, INSIG1, INTU, INVS, IQCE, IQCG, ITCH, ITGA11, ITGA8, ITGAV, ITGB5, ITGB8, ITIH1, ITM2C, ITPKA, ITSN1, IVD, KANSL3, KAT6B, KCNK2, KCNS1, KCNS2, KDM6A, KDSR, KIAA1033, KIAA1143, KIAA1199, KIAA1456, KIAA1462, KIAA1522, KIAA1524, KIAA1549, KIAA1715, KIAA1755, KIDINS220, KIF14, KIF2A, KIF21A, KIF3A, KIT, KLC1, KLC2, KLF17, KLF6, KLHL7, KLRG1, KMT2D, KRT7, KRT18, KRT19, KRT34, KRTAP1-1, KRTAP1-5, KRTAP2-3, L3MBTL2, LAMA2, LAMB1, LAMB2P1, LARP4, LATS2, LDLR, LEMD3, LETM2, LGALS3, LGALS8, LGI2, LGR4, LHX9, LIMS1, LINC00341, LINC00472, LINC00570, LINC00578, LINC00607, LINC00657, LINC00678, LINC00702, LINC00886, LINC00961, LINC01011, LINC01118, LINC01204, LINCR-0002, LINGO2, LMAN2L, LMNA, LMO7, LMOD1, LOC400927, LONP1, LOX, LPHN1, LRBA, LRCH4, LRIG1, LRP4, LRP8, LRRC1, LRRC32, LRRC39, LRRC8A, LSAMP, LSS, LTBR, LUC7L2, LUM, LYPD1, LYRM1, LZTS2, MACROD2, MAFB, MAGED4, MAGED4B, MAMDC2, MAN1A2, MAN2A1, MAN2C1, MANEA, MAP4K4, MAPK10, MAPK13, MARCH7, MARCH8, MASP1, MB, MB21D2, MBD1, MBOAT7, MC4R, MCM10, MDM2, MDN1, MEAF6, MECP2, MED1, MED13L, MEDAG, MEF2D, MEGF6, MEIS2, MEMO1, MEPCE, MFGE8, MFN2, MIAT, MICAL2, MINPP1, MIR612, MKL1, MKLN1, MKNK2, MLLT4, MLLT10, MLST8, MMAB, MMP10, MMP24, MMS19, MMS22L, MN1, MORF4L1, MOXD1, MPPE1, MPZL1, MRPL3, MRPL45, MRPL55, MRPS28, MRVI1, MSANTD3, MSC, MSH2, MSH4, MSH6, MSL3, MSMO1, MSRB3, MTAP, MTERF3, MTERFD1, MTHFD1L, MTMR3, MTMR9, MTRR, MUM1, MVD, MVK, MXRA5, MYADM, MYB, MYCBP2, MYLK, MYO1D, MYO9B, MYOF, NA, NAA35, NAALADL2, NADK, NAE1, NAGS, NASP, NAV1, NAV2, NCOA1, NCOA3, NCOA4, NCSTN, NDNF, NEDD4, NELFA, NEO1, NEURL1B, NF2, NFASC, NFE2L1, NFX1, NGF, NGFR, NHLH1, NID1, NID2, NIPA1, NKX3-1, NLGN1, NLN, NOL10, NOMO3, NOTCH3, NOTUM, NOVA2, NOX4, NPEPPS, NRD1, NREP, NRG1, NRROS, NSUN4, NT5C2, NT5E, NTNG1, NUDT4, NUP153, NUP35, NUP50, NUPL1, NUSAP1, OCLN, ODF2, OLR1, OS9, OSBPL3, OSBPL6, OSBPL10, OSMR, OXCT1, OXCT2, P4HA1, P4HB, PABPC1, PAIP2B, PAK4, PAPD4, PARD3, PARN, PARP14, PARP4, PARVB, PAX6, PBLD, PBX3, PCBP2, PCCB, PCDH10, PCDHGB3, PCGF3, PCM1, PCMTD2, PCNXL2, PCSK9, PDE1C, PDE3A, PDE4A, PDE5A, PDE7A, PDGFD, PDGFRB, PDLIM7, PDS5B, PDXDC1, PDXDC2P, PEAR1, PELI1, PEPD, PEX5, PFKP, PHACTR3, PHF19, PHF8, PHRF1, PHTF2, PI4K2A, PIEZO1, PIGN, PIGU, PIK3C2B, PIK3CD, PIK3R1, PIKFYVE, PIM2, PITPNA, PITPNB, PITPNM1, PITPNM3, PLAU, PLEC, PLEK2, PLEKHA1, PLEKHA6, PLEKHB2, PLEKHH2, PLSCR1, PLSCR3, PLXNB2, PLXNC1, PMS1, PNISR, PODN, POLE3, POLN, POLR1A, POLR3D, POMT2, POSTN, POU2F1, PPAPDC1A, PPARA, PPARG, PPFIBP1, PPIP5K1, PPIP5K2, PPM1E, PPP1R12A, PPP1R26, PPP3CA, PPP6R1, PPP6R2, PRKCA, PRKDC, PRKG1, PRMT1, PRNP, PRPF31, PRPH2, PRRG4, PRSS23, PRUNE2, PSMA4, PSMC1, PSMD6, PSMD6-AS2, PTCH1, PTGIS, PTK2B, PTPN14, PTX3, PUF60, PUS7, PVR, PXK, PXN, QKI, RAB2B, RAB30, RAB34, RAB38, RAB44, RAD1, RAD9B, RAD23B, RAF1, RALB, RAP1GDS1, RAPGEF1, RARG, RARS, RARS2, RASIP1, RASSF8, RBBP8, RBCK1, RCOR3, RBFOX2, RBKS, RBM10, RDX, RERE, RFTN1, RFWD2, RFX3-AS1, RGCC, RGL1, RGS10, RGS3, RIF1, RNF14, RNF19A, RNF130, RNF144A, RNF213, RNF38, RNFT1, ROR1, ROR2, RPA1, RPF2, RPL10, RPS10, RPS6KB2, RPS6KC1, RRBP1, RWDD4, SAMD4A, SAMD9, SAMD9L, SAR1A, SART3, SCAF4, SCAF8, SCARNA9, SCD, SCLT1, SCO1, SDCBP, SEC14L1, SEC22A, SEC24A, SEC24B, SEC61A1, SENP6, SEPT9, SERGEF, SERPINE2, SF1, SF3B3, SGIP1, SGK3, SGMS1, SGOL2, SGPL1, SH2B3, SH3RF1, SH3YL1, SHROOM3, SIGLEC10, SKA2, SKIL, SKP1, SLC12A2, SLC24A3, SLC25A16, SLC25A17, SLC34A3, SLC35F3, SLC39A3, SLC39A10, SLC4A4, SLC4A11, SLC41A1, SLC44A2, SLC46A2, SLC6A15, SLC7A6, SLC7A8, SLC7A11, SLC9A3, SLIT3, SMARCA4, SMARCC2, SMC4, SMC6, SMCHD1, SMG1, SMG1P3, SMOX, SMPD4, SMTN, SMYD3, SMYD5, SNAP23, SNED1, SNHG16, SNX7, SNX14, SNX24, SNX7, SOCS2, SOCS6, SOGA2, SON, SORBS2, SORCS1, SORCS2, SOS2, SOX7, SPATA18, SPATA20, SPATA5, SPATS2, SPDYA, SPEF2, SPG20, SPIDR, SPINK5, SPRED2, SPRYD7, SQLE, SQRDL, SQSTM1, SRCAP, SREBF1, SRGAP1, SRRM1, SRSF3, SSBP1, STAC2, STARD4, STAT1, STAT3, STAT4, STAU1, STC2, STEAP2, STK32B, STRAD8, STRIP1, STRN4, STS, STX16, STXBP4, STXBP6, SULF1, SUPT20H, SVEP1, SYNE1, SYNE2, SYNGR2, SYNPO, SYNPO2, SYNPO2L, SYT15, SYTL2, TACC1, TAF2, TAGLN3, TANC2, TANGO6, TARBP1, TARS, TASP1, TBC1D15, TBCA, TBL1XR1, TBL2, TCF12, TCF4, TCF7L2, TEKT4P2, TENC1, TENM2, TEP1, TET1, TET3, TEX21P, TFCP2, TGFA, TGFB2, TGFB3, TGFB1, TGFBR1, TGFBRAP1, TGM2, THADA, THAP4, THBS2, THRB, TIAM1, TIMP2, TJAP1, TJP2, TLE3, TLK1, TMC3, TMEM67, TMEM102, TMEM119, TMEM134, TMEM154, TMEM189-UBE2V1, TMEM214, TMEM256-PLSCR3, TMEM47, TMEM50B, TMEM63A, TMX3, TNC, TNFAIP3, TNFAIP8L3, TNFRSF12A, TNFRSF14, TNIP1, TNKS1BP1, TNPO3, TNRC18P1, TNS1, TNS3, TNXB, TOE1, TOMM40, TOMM5, TOPORS, TP53AIP1, TP53INP1, TPRG1, TRAF3, TRAK1, TRAPPC12, TRIB1, TRIM2, TRIM23, TRIM26, TRIM28, TRIM65, TRIM66, TRMT1L, TRPC4, TRPS1, TSC2, TSHZ1, TSHZ2, TSPAN11, TSPAN18, TSPAN2, TSPAN7, TSSK3, TTC7A, TTC7B, TUBB2C, TUBB3, TUBE1, TXNIP, TXNL1, TXNL4B, TXNRD1, TYW5, U2SURP, UBAP2L, UBE2D3, UBE2G2, UBE2L3, UBE2V1, UBN2, UBQLN4, UCHL5, UHMK1, UHRF1BP1L, UNC13B, UNC5B, URGCP, URGCP-MRPS24, USP19, USP7, USP27X, UVRAG, VANGL1, VARS2, VAV2, VCL, VDAC2, VIM-AS1, VIPAS39, VPS13A, VPS29, VPS41, VPS51, VSTM2L, VWA8, VWF, WDR19, WDR27, WDR37, WDR48, WDR90, WDR91, WHSC2, WIPF1, WISP1, WNK1, WNT5B, WNT10B, WSB1, WWTR1, XDH, XIAP, XRN2, YAP1, YDJC, YES1, YPEL5, YTHDF3, Z24749, ZAK, ZBTB10, ZBTB24, ZBTB26, ZBTB7A, ZC3H12C, ZC3H14, ZC3H18, ZCCHC5, ZCCHC8, ZCCHC11, ZEB1, ZEB2, ZFAND1, ZFAND5, ZFP82, ZHX3, ZMIZ1, ZMIZ1-AS1, ZMIZ2, ZMYM2, ZNF12, ZNF138, ZNF148, ZNF208, ZNF212, ZNF219, ZNF227, ZNF232, ZNF24, ZNF268, ZNF28, ZNF280D, ZNF281, ZNF335, ZNF350, ZNF37A, ZNF37BP, ZNF395, ZNF426, ZNF431, ZNF583, ZNF618, ZNF621, ZNF652, ZNF655, ZNF660, ZNF674, ZNF680, ZNF730, ZNF74, ZNF764, ZNF777, ZNF778, ZNF780A, ZNF7804A, ZNF79, ZNF827, ZNF836, ZNF837, ZNF839, ZNF91 and ZSCAN25.

In another specific aspect described herein, the gene, or the RNA transcript is transcribed from a gene that is not SMN2.

In another specific aspect described herein, the gene, or the RNA transcript is transcribed from a gene that is not selected from: ABHD10, ADAM12, AKT1, ANXA11, APLP2, APPL2, ARMCX6, ATG5, AXIN1, BAIAP2, CCNB1IP1, CCT7, CEP57, CSF1, DLGAP4, EPN1, ERGIC3, FOXM1, GGCT, GRAMD3, HSD17B4, LARP7, LRRC42, MADD, MAN1B1, MRPL39, PCBP4, PPHLN1, PRKACB, RAB23, RAP1A, RCC1, SREK1, STRN3 and TNRC6A.

In another specific aspect described herein, the gene, or the RNA transcript is transcribed from a gene that is not selected from: ABHD10, ADAM2, AKT1, ANXA11, APLP2, APPL2, ARMCX6, ATG5, AXIN1, BAIAP2, CCNB1IP1, CCT7, CEP57, CSF1, DLGAP4, EPN1, ERGIC3, FOXM1, GGCT, GRAMD3, HSD17B4, LARP7, LRRC42, MADD, MAN1B1, MRPL39, PCBP4, PPHLN1, PRKACB, RAB23, RAP1A, RCC1, SMN2, SREK1, STRN3 and TNRC6A.

In another specific aspect described herein, the gene, or the RNA transcript is transcribed from a gene that is SMN2.

In another specific aspect described herein, the gene, or the RNA transcript is transcribed from a gene that is selected from: ABHD10, ADAM12, AKT1, ANXA11, APLP2, APPL2, ARMCX6, ATG5, AXIN1, BAIAP2, CCNB1IP1, CCT7, CEP57, CSF1, DLGAP4, EPN1, ERGIC3, FOXM1, GGCT, GRAMD3, HSD17B4, LARP7, LRRC42, MADD, MAN1B1, MRPL39, PCBP4, PPHLN1, PRKACB, RAB23, RAP1A, RCC1, SREK1, STRN3 and TNRC6A.

In another specific aspect described herein, the gene, or the RNA transcript is transcribed from a gene that is selected from: ABHD10, ADAM12, AKT1, ANXA11, APLP2, APPL2, ARMCX6, ATG5, AXIN1, BAIAP2, CCNB1IP1, CCT7, CEP57, CSF1, DLGAP4, EPN1, ERGIC3, FOXM1, GGCT, GRAMD3, HSD17B4, LARP7, LRRC42, MADD, MAN1B1, MRPL39, PCBP4, PPHLN1, PRKACB, RAB23, RAP1A, RCC1, SMN2, SREK1, STRN3 and TNRC6A.

In one aspect, provide herein is a method of modulating the amount and modifying the type of a protein produced by a cell containing the artificial gene construct as described above, the method comprising contacting the cell with a compound of Formula (I) or a form thereof, wherein Formula (I) is:

or a form thereof, wherein
W is CH=CH or S;
X is $CH_2$, $CH(C_{1-4}alkyl)$, $C(C_{1-4}alkyl)_2$, CH=CH, O, $NR_5$, or a bond;
A is aryl, heteroaryl, heterocyclyl, or $C_{9-10}$cycloalkyl,
wherein aryl is selected from phenyl and naphthyl, each optionally substituted with 1, 2, 3, or 4 substituents each selected from $R_1$,
wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from $R_1$,
wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from $R_2$, and
wherein $C_{9-10}$cycloalkyl is a saturated or partially unsaturated bicyclic ring system optionally substituted with 1, 2, 3, 4, or 5 substituents each selected from $R_2$;
B is heterocyclyl,
wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from $R_4$;
$R_1$ is halogen, hydroxyl, cyano, $C_{1-4}$alkyl, halo-$C_{1-4}$alkyl, amino, $C_{1-4}$alkyl-amino, $(C_{1-4}alkyl)_2$-amino, amino-$C_{1-4}$alkyl, $C_{1-4}$alkyl-amino-$C_{1-4}$alkyl, $(C_{1-4}alkyl)_2$-amino-$C_{1-4}$alkyl, amino-carbonyl, $C_{1-4}$alkyl-amino-carbonyl, $(C_{1-4}alkyl)_2$-amino-carbonyl, $C_{1-4}$alkyl-amino-carbonyl-$C_{1-4}$alkyl, $(C_{1-4}alkyl)_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}alkyl)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, heterocyclyl-$C_{1-4}$alkoxy, phenyl, or phenyl-$C_{1-4}$alkoxy,
wherein heteroaryl is a saturated monocyclic or bicyclic ring system having 1, 2, or 3 heteroatom ring members selected from N, O, and S,
wherein heterocyclyl is a saturated or partially unsaturated monocyclic or bicyclic ring system having 1, 2, or 3 heteroatom ring members selected from N, O, and S, and wherein each instance of phenyl, heteroaryl or heterocyclyl is optionally substituted with 1, or 2 substituents each selected from R₃;

R₂ is halogen, hydroxyl, cyano, oxo, hydroxyl-imino. $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, hydroxyl-$C_{1-4}$alkyl, $C_{1-4}$alkoxy, $C_{1-4}$alkoxy-carbonyl, $C_{2-4}$alkenyl, $C_{3-7}$cycloalkyl, or heterocyclyl-$C_{1-4}$alkyl, wherein heterocyclyl is a saturated or partially unsaturated monocyclic or bicyclic ring system having 1, 2, or 3 heteroatom ring members selected from N, O, and S, and wherein each instance of heterocyclyl is optionally substituted with 1, or 2 substituents each selected from R₃;

R₃ is halogen, hydroxyl, nitro, oxo, hydroxyl-imino, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, $C_{1-4}$alkyl-amino-carbonyl, $(C_{1-4}$alkyl$)_2$-amino-carbonyl, $C_{1-4}$alkyl-amino-carbonyl-$C_{1-4}$alkyl, $(C_{1-4}$alkyl$)_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}$alkyl$)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, phenyl, or phenyl-$C_{1-4}$alkoxy;

R₄ is independently selected from halogen, $C_{1-4}$alkyl, hydroxyl-$C_{1-4}$alkyl, amino, $C_{1-4}$alkyl-amino, $(C_{1-4}$alkyl$)_2$-amino or hydroxyl-$C_{1-4}$alkyl-amino; and R₅ is hydrogen, $C_{1-4}$alkyl, or hydroxyl-$C_{1-4}$alkyl;

wherein a form of the compound is selected from the group consisting of a prodrug, salt, hydrate, solvate, clathrate, isotopologue, racemate, enantiomer, diastereomer, stereoisomer, polymorph and tautomer form thereof.

In another aspect, provide herein is a method of modulating the amount and modifying the type of a protein produced by a cell containing the artificial gene construct as described above, the method comprising contacting the cell with a compound of Formula (I) or a form thereof, wherein Formula (I) is selected from a compound of Formula (Ia) and Formula (Ib):

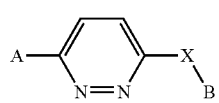

(Ia)

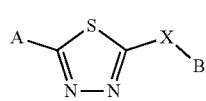

(Ib)

or a form thereof, wherein

X is $CH_2$, $CH(C_{1-4}$alkyl), $C(C_{1-4}$alkyl$)_2$, CH=CH, O, $NR_5$, or a bond;

A is aryl, heteroaryl, heterocyclyl, or $C_{9-10}$cycloalkyl, wherein aryl is selected from phenyl and naphthyl, each optionally substituted with 1, 2, 3, or 4 substituents each selected from R₁, wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from R₁, wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from R₂, and wherein $C_{9-10}$cycloalkyl is a saturated or partially unsaturated bicyclic ring system optionally substituted with 1, 2, 3, 4, or 5 substituents each selected from R₂;

B is heterocyclyl, wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from R₄, R₁ is halogen, hydroxyl, cyano, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, $C_{1-4}$alkyl-amino-carbonyl, $C_{1-4}$alkyl-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}$alkyl$)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, heterocyclyl-$C_{1-4}$alkoxy, phenyl, or phenyl-$C_{1-4}$alkoxy, wherein heteroaryl is a saturated monocyclic or bicyclic ring system having 1, 2, or 3 heteroatom ring members selected from N, O, and S, wherein heterocyclyl is a saturated or partially unsaturated monocyclic or bicyclic ring system having 1, 2, or 3 heteroatom ring members selected from N, O, and S, and wherein each instance of phenyl, heteroaryl or heterocyclyl is optionally substituted with 1, or 2 substituents each selected from R₃;

R₂ is halogen, hydroxyl, cyano, oxo, hydroxyl-imino, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, amino-carbonyl, hydroxyl-$C_{1-4}$alkyl, $C_{1-4}$alkoxy, $C_{1-4}$alkoxy-carbonyl, $C_{2-4}$alkenyl, $C_{3-7}$cycloalkyl, or heterocyclyl-$C_{1-4}$alkyl;

R₃ is halogen, hydroxyl, nitro, oxo, hydroxyl-imino, $C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, $C_{1-4}$alkyl-amino-carbonyl, $C_{1-4}$alkyl-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}$alkyl$)_2$-amino-$C_{1-4}$alkoxy, $C_{1-4}$alkyl-carbonyl-amino- C₁₋₄alkoxy, C₁₋₄alkoxy-C₁₋₄alkoxy, C₁₋₄alkoxy-carbonyl, C₁₋₄alkoxy-carbonyl-amino, C₁₋₄alkoxy-carbonyl-amino-C₁₋₄alkoxy, C₂₋₄alkenyl, C₂₋₄alkenyl-amino-carbonyl, C₃₋₇cycloalkyl, C₃₋₇cycloalkyl-C₁₋₄alkoxy, C₃₋₇cycloalkenyl, heteroaryl, heteroaryl-C₁₋₄alkyl, heteroaryl-C₁₋₄alkyl-amino, heteroaryl-C₁₋₄alkyl-amino-carbonyl, heteroaryl-C₁₋₄alkyl-carbonyl-amino, heteroaryl-C₁₋₄alkyl-amino-carbonyl-C₁₋₄alkyl, heteroaryl-C₁₋₄alkyl-carbonyl-amino-C₁₋₄alkyl, heterocyclyl, heterocyclyl-C₁₋₄alkyl, phenyl, or phenyl-C₁₋₄alkoxy;

R₄ is independently selected from halogen, C₁₋₄alkyl, hydroxyl-C₁₋₄alkyl, amino, C₁₋₄alkyl-amino, (C₁₋₄alkyl)₂-amino or hydroxyl-C₁₋₄alkyl-amino; and R₅ is hydrogen, C₁₋₄alkyl, or hydroxyl-C₁₋₄alkyl;

wherein a form of the compound is selected from the group consisting of a prodrug, salt, hydrate, solvate, clathrate, isotopologue, racemate, enantiomer, diastereomer, stereoisomer, polymorph and tautomer form thereof.

In a specific aspect, in the context of DNA, the nucleotide sequence encoding the intronic REMS comprises a sequence selected from the group consisting of ANGAgtrngn (SEQ ID NO: 1809), CNGAgtrngn (SEQ ID NO: 1810), GNGAgtrngn (SEQ ID NO: 1811), TNGAgtrngn (SEQ ID NO: 1812), NAGAgtrngn (SEQ ID NO: 1813), NCGAgtrngn (SEQ ID NO: 1814), NGGAgtrngn (SEQ ID NO: 1815), NTGAgtrngn (SEQ ID NO: 1816), AAGAgtrngn (SEQ ID NO: 1817), ACGAgtrngn (SEQ ID NO: 1818), AGGAgtrngn (SEQ ID NO: 1819), ATGAgtrngn (SEQ ID NO: 1820), CAGAgtrngn (SEQ ID NO: 1821), CCGAgtrngn (SEQ ID NO: 1822), CGGAgtrngn (SEQ ID NO: 1823), CTGAgtrngn (SEQ ID NO: 1824), GAGAgtrngn (SEQ ID NO: 1825), GCGAgtrngn (SEQ ID NO: 1826), GGGAgtrngn (SEQ ID NO: 1827), GTGAgtrngn (SEQ ID NO: 1828), TAGAgtrngn (SEQ ID NO: 1829), TCGAgtrngn (SEQ ID NO: 1830), TGGAgtrngn (SEQ ID NO: 1831) and TTGAgtrngn (SEQ ID NO: 1832), wherein r is adenine or guanine and n or N is any nucleotide. In a further specific aspect, in the context of DNA, the nucleotide sequence encoding the intronic REMS comprises a sequence selected from the group consisting of ANGAgtragt (SEQ ID NO: 1833), CNGAgtragt (SEQ ID NO: 1834), GNGAgtragt (SEQ ID NO: 1835), TNGAgtragt (SEQ ID NO: 1836), NAGAgtragt (SEQ ID NO: 1837), NCGAgtragt (SEQ ID NO: 1838), NGGAgtragt (SEQ ID NO: 1839), NTGAgtragt (SEQ ID NO: 1840), AAGAgtragt (SEQ ID NO: 1841), ACGAgtragt (SEQ ID NO: 1842), AGGAgtragt (SEQ ID NO: 1843), ATGAgtragt (SEQ ID NO: 1844), CAGAgtragt (SEQ ID NO: 1845), CCGAgtragt (SEQ ID NO: 1846), CGGAgtragt (SEQ ID NO: 1847), CTGAgtragt (SEQ ID NO: 1848), GAGAgtragt (SEQ ID NO: 1849), GCGAgtragt (SEQ ID NO: 1850), GGGAgtragt (SEQ ID NO: 1851), GTGAgtragt (SEQ ID NO: 1852), TAGAgtragt (SEQ ID NO: 1853), TCGAgtragt (SEQ ID NO: 1854), TGGAgtragt (SEQ ID NO: 1855) and TTGAgtragt (SEQ ID NO: 1856), wherein r is adenine or guanine and N is any nucleotide. In one or more aspects provided herein, N is adenine or guanine. In various specific aspects, the nucleotide sequence encoding the intronic REMS is a nucleotide sequence encoding a non-endogenous intronic REMS, i.e., a precursor RNA transcript comprising the non-endogenous intronic REMS not naturally found in the DNA sequence of the artificial construct.

In one aspect, provided herein is a method for modifying RNA splicing in order to produce a mature mRNA transcript having an iExon, the method comprising contacting a pre-mRNA transcript with a compound of Formula (I) or a form thereof, wherein the pre-mRNA transcript comprises two exons and an intron, wherein a first exon is upstream of the intron and a second exon is downstream of the intron, wherein the intron comprises in 5' to 3' order: a first 5' splice site, a first branch point, a first 3' splice site, an intronic recognition element for splicing modifier (iREMS), a second branch point, and a second 3' splice site, wherein the iREMS comprises an RNA sequence GAgurngn, wherein r is adenine or guanine and n is any nucleotide, and wherein Formula (I) is:

or a form thereof, wherein

W is CH=CH or S;

X is CH₂, CH(C₁₋₄alkyl), C(C₁₋₄alkyl)₂, CH=CH, O, NR₅, or a bond;

A is aryl, heteroaryl, heterocyclyl, or C₉₋₁₀cycloalkyl, wherein aryl is selected from phenyl and naphthyl, each optionally substituted with 1, 2, 3, or 4 substituents each selected from R₁, wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from R₁, wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from R₂, and wherein C₉₋₁₀cycloalkyl is a saturated or partially unsaturated bicyclic ring system optionally substituted with 1, 2, 3, 4, or 5 substituents each selected from R₂;

B is heterocyclyl, wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from R₄;

R₁ is halogen, hydroxyl, cyano, C₁₋₄alkyl, halo-C₁₋₄alkyl, amino, C₁₋₄alkyl-amino, (C₁₋₄alkyl)₂-amino, amino-C₁₋₄alkyl, C₁₋₄alkyl-amino-C₁₋₄alkyl, (C₁₋₄alkyl)₂-amino-C₁₋₄alkyl, amino-carbonyl, C₁₋₄alkyl-amino-carbonyl, (C₁₋₄alkyl)₂-amino-carbonyl, C₁₋₄alkyl-amino-carbonyl-C₁₋₄alkyl, (C₁₋₄alkyl)₂-amino-carbonyl-C₁₋₄alkyl, C₁₋₄alkyl-carbonyl-amino, C₁₋₄alkyl-carbonyl-amino-C₁₋₄alkyl, hydroxyl-C₁₋₄alkyl, C₁₋₄alkyl-carbonyl, C₁₋₄alkoxy, halo-C₁₋₄alkoxy, amino-C₁₋₄alkoxy, hydroxyl-C₁₋₄alkoxy, C₁₋₄alkyl-C₁₋₄alkoxy, C₁₋₄alkyl-amino-C₁₋₄alkoxy, (C₁₋₄alkyl)₂-amino-C₁₋₄alkoxy, C₁₋₄alkyl-carbonyl-amino-C₁₋₄alkoxy, C₁₋₄alkoxy-C₁₋₄alkoxy, C₁₋₄alkoxy-carbonyl, C₁₋₄alkoxy-carbonyl-amino, C₁₋₄alkoxy-carbonyl-amino-C₁₋₄alkoxy, C₂₋₄alkenyl, C₂₋₄alkenyl-amino-carbonyl, C₃₋₇cycloalkyl, C₃₋₇cycloalkyl-C₁₋₄alkoxy, C₃₋₇cycloalkenyl, heteroaryl, heteroaryl-C₁₋₄alkyl, heteroaryl-C₁₋₄alkyl-amino, heteroaryl-C₁₋₄alkyl-amino-carbonyl, heteroaryl-C₁₋₄alkyl-carbonyl-amino, heteroaryl-C₁₋₄alkyl-amino-carbonyl-C₁₋₄alkyl, heteroaryl-C₁₋₄alkyl-carbonyl-amino-C₁₋₄alkyl, heterocyclyl, heterocyclyl-C₁₋₄alkyl, heterocyclyl-C₁₋₄alkoxy, phenyl, or phenyl-C₁₋₄alkoxy, wherein heteroaryl is a saturated monocyclic or bicyclic ring system having 1, 2, or 3 heteroatom ring members selected from N, O, and S, wherein heterocyclyl is a saturated or partially unsaturated monocyclic or bicyclic ring system having 1, 2, or 3 heteroatom ring members selected from N, O, and S, and wherein each instance of phenyl, heteroaryl or heterocyclyl is optionally substituted with 1, or 2 substituents each selected from $R_3$;

$R_2$ is halogen, hydroxyl, cyano, oxo, hydroxyl-imino, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, hydroxyl-$C_{1-4}$alkyl, $C_{1-4}$alkoxy, $C_{1-4}$alkoxy-carbonyl, $C_{2-4}$alkenyl, $C_{3-7}$cycloalkyl, or heterocyclyl-$C_{1-4}$alkyl, wherein heterocyclyl is a saturated or partially unsaturated monocyclic or bicyclic ring system having 1, 2, or 3 heteroatom ring members selected from N, O, and S, and wherein each instance of heterocyclyl is optionally substituted with 1, or 2 substituents each selected from $R_3$;

$R_3$ is halogen, hydroxyl, nitro, oxo, hydroxyl-imino, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, $C_{1-4}$alkyl-amino-carbonyl, $(C_{1-4}$alkyl$)_2$-amino-carbonyl, $C_{1-4}$alkyl-amino-carbonyl-$C_{1-4}$alkyl, $(C_{1-4}$alkyl$)_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}$alkyl$)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, phenyl, or phenyl-$C_{1-4}$alkoxy;

$R_4$ is independently selected from halogen, $C_{1-4}$alkyl, hydroxyl-$C_{1-4}$alkyl, amino, $C_{1-4}$alkyl-amino, $(C_{1-4}$alkyl$)_2$-amino or hydroxyl-$C_{1-4}$alkyl-amino; and $R_5$ is hydrogen, $C_{1-4}$alkyl, or hydroxyl-$C_{1-4}$alkyl;

wherein a form of the compound is selected from the group consisting of a prodrug, salt, hydrate, solvate, clathrate, isotopologue, racemate, enantiomer, diastereomer, stereoisomer, polymorph and tautomer form thereof.

In another aspect, provided herein is a method for modifying RNA splicing in order to modulate the amount of a mature mRNA transcript produced by a pre-mRNA transcript, the method comprising contacting the pre-mRNA transcript with a compound of Formula (I) or a form thereof, wherein the pre-mRNA transcript comprises two exons and an intron, wherein a first exon is upstream of the intron and a second exon is downstream of the intron, wherein the intron comprises a RNA nucleotide sequence comprising in 5' to 3' order: an intronic recognition element for splicing modifier (iREMS), a branch point, and a 3' splice site, wherein the iREMS comprises an RNA sequence GAgurngn, wherein r is adenine or guanine and n is any nucleotide, and wherein Formula (I) is:

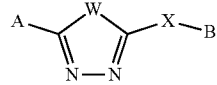

or a form thereof, wherein

W is CH=CH or S;

X is $CH_2$, $CH(C_{1-4}$alkyl$)$, $C(C_{1-4}$alkyl$)_2$, CH=CH, O, $NR_5$, or a bond;

A is aryl, heteroaryl, heterocyclyl, or $C_{9-10}$cycloalkyl, wherein aryl is selected from phenyl and naphthyl, each optionally substituted with 1, 2, 3, or 4 substituents each selected from $R_1$, wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from $R_1$, wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from $R_2$, and wherein $C_{9-10}$cycloalkyl is a saturated or partially unsaturated bicyclic ring system optionally substituted with 1, 2, 3, 4, or 5 substituents each selected from $R_2$;

B is heterocyclyl, wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from $R_4$;

$R_1$ is halogen, hydroxyl, cyano, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, $C_{1-4}$alkyl-amino-carbonyl, $(C_{1-4}$alkyl$)_2$-amino-carbonyl, $C_{1-4}$alkyl-amino-carbonyl-$C_{1-4}$alkyl, $(C_{1-4}$alkyl$)_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}$alkyl$)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, heterocyclyl-$C_{1-4}$alkoxy, phenyl, or phenyl-$C_{1-4}$alkoxy, wherein heteroaryl is a saturated monocyclic or bicyclic ring system having 1, 2, or 3 heteroatom ring members selected from N, O, and S, wherein heterocyclyl is a saturated or partially unsaturated monocyclic or bicyclic ring system having 1, 2, or 3 heteroatom ring members selected from N, O, and S, and wherein each instance of phenyl, heteroaryl or heterocyclyl is optionally substituted with 1, or 2 substituents each selected from $R_3$;

$R_2$ is halogen, hydroxyl, cyano, oxo, hydroxyl-imino, $C_{1-4}$alkyl, halo-$C_{1-4}$alkyl, amino, $C_{1-4}$alkyl-amino, $(C_{1-4}$ $_4$alkyl)$_2$-amino, amino-C$_{1-4}$alkyl, C$_{1-4}$alkyl-amino-C$_{1-4}$alkyl, (C$_{1-4}$alkyl)$_2$-amino-C$_{1-4}$alkyl, amino-carbonyl, hydroxyl-C$_{1-4}$alkyl, C$_{1-4}$alkoxy, C$_{1-4}$alkoxy-carbonyl, C$_{2-4}$alkenyl, C$_{3-7}$cycloalkyl, or heterocyclyl-C$_{1-4}$alkyl,
wherein heterocyclyl is a saturated or partially unsaturated monocyclic or bicyclic ring system having 1, 2, or 3 heteroatom ring members selected from N, O, and S, and
wherein each instance of heterocyclyl is optionally substituted with 1, or 2 substituents each selected from R$_3$;
R$_3$ is halogen, hydroxyl, nitro, oxo, hydroxyl-imino, C$_{1-4}$alkyl, halo-C$_{1-4}$alkyl, amino, C$_{1-4}$alkyl-amino, (C$_{1-4}$alkyl)$_2$-amino, amino-C$_{1-4}$alkyl, C$_{1-4}$alkyl-amino-C$_{1-4}$alkyl, (C$_{1-4}$alkyl)$_2$-amino-C$_{1-4}$alkyl, amino-carbonyl, C$_{1-4}$alkyl-amino-carbonyl, (C$_{1-4}$alkyl)$_2$-amino-carbonyl, C$_{1-4}$alkyl-amino-carbonyl-C$_{1-4}$alkyl, (C$_{1-4}$alkyl)$_2$-amino-carbonyl-C$_{1-4}$alkyl, C$_{1-4}$alkyl-carbonyl-amino, C$_{1-4}$alkyl-carbonyl-amino-C$_{1-4}$alkyl, hydroxyl-C$_{1-4}$alkyl, C$_{1-4}$alkyl-carbonyl, C$_{1-4}$alkoxy, halo-C$_{1-4}$alkoxy, amino-C$_{1-4}$alkoxy, hydroxyl-C$_{1-4}$alkoxy, C$_{1-4}$alkyl-C$_{1-4}$alkoxy, C$_{1-4}$alkyl-amino-C$_{1-4}$alkoxy, (C$_{1-4}$alkyl)$_2$-amino-C$_{1-4}$alkoxy, C$_{1-4}$alkyl-carbonyl-amino-C$_{1-4}$alkoxy, C$_{1-4}$alkoxy-C$_{1-4}$alkoxy, C$_{1-4}$alkoxy-carbonyl, C$_{1-4}$alkoxy-carbonyl-amino, C$_{1-4}$alkoxy-carbonyl-amino-C$_{1-4}$alkoxy, C$_{2-4}$alkenyl, C$_{2-4}$alkenyl-amino-carbonyl, C$_{3-7}$cycloalkyl, C$_{3-7}$cycloalkyl-C$_{1-4}$alkoxy, C$_{3-7}$cycloalkenyl, heteroaryl, heteroaryl-C$_{1-4}$alkyl, heteroaryl-C$_{1-4}$alkyl-amino, heteroaryl-C$_{1-4}$alkyl-amino-carbonyl, heteroaryl-C$_{1-4}$alkyl-carbonyl-amino, heteroaryl-C$_{1-4}$alkyl-amino-carbonyl-C$_{1-4}$alkyl, heteroaryl-C$_{1-4}$alkyl-carbonyl-amino-C$_{1-4}$alkyl, heterocyclyl, heterocyclyl-C$_{1-4}$alkyl, phenyl, or phenyl-C$_{1-4}$alkoxy;
R$_4$ is independently selected from halogen, C$_{1-4}$alkyl, hydroxyl-C$_{1-4}$alkyl, amino, C$_{1-4}$alkyl-amino, (C$_{1-4}$alkyl)$_2$-amino or hydroxyl-C$_{1-4}$alkyl-amino; and
R$_5$ is hydrogen, C$_{1-4}$alkyl, or hydroxyl-C$_{1-4}$alkyl;
wherein a form of the compound is selected from the group consisting of a prodrug, salt, hydrate, solvate, clathrate, isotopologue, racemate, enantiomer, diastereomer, stereoisomer, polymorph and tautomer form thereof.

In a specific aspect of the foregoing aspect, the intron further comprises in 5' to 3' order: a 5' splice site, a branch point, and a 3' splice site upstream of the iREMS.

In another aspect, provided herein is a method for modifying RNA splicing in order to modulate the amount of a mature mRNA transcript produced by a pre-mRNA transcript, the method comprising contacting the pre-mRNA transcript with a compound of Formula (I) or a form thereof, wherein the pre-mRNA transcript comprises three exons and two introns, wherein three exons and two introns are in the following order 5' to 3': a first exon, a first intron, a second exon, a second intron and a third exon, wherein the first intron comprises a RNA nucleotide sequence comprising in 5' to 3' order: a first 5' splice site, a first branch point and a first 3' splice site, wherein the second intron comprises a RNA nucleotide sequence comprising in 5' to 3' order: a second 5' splice site, an intronic recognition element for splicing modifier (iREMS), a second branch point, and a second 3' splice site, wherein the iREMS comprises an RNA sequence GAgurngn, wherein r is adenine or guanine and n is any nucleotide, and wherein Formula (I) is:

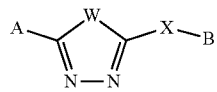

(I)

or a form thereof, wherein
W is CH=CH or S;
X is CH$_2$, CH(C$_{1-4}$alkyl), C(C$_{1-4}$alkyl)$_2$, CH=CH, O, NR$_5$, or a bond;
A is aryl, heteroaryl, heterocyclyl, or C$_{9-10}$cycloalkyl,
wherein aryl is selected from phenyl and naphthyl, each optionally substituted with 1, 2, 3, or 4 substituents each selected from R$_1$,
wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from R$_1$,
wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from R$_2$, and
wherein C$_{9-10}$cycloalkyl is a saturated or partially unsaturated bicyclic ring system optionally substituted with 1, 2, 3, 4, or 5 substituents each selected from R$_2$;
B is heterocyclyl,
wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from R$_4$;
R$_1$ is halogen, hydroxyl, cyano, C$_{1-4}$alkyl, halo-C$_{1-4}$alkyl, amino, C$_{1-4}$alkyl-amino, (C$_{1-4}$alkyl)$_2$-amino, amino-C$_{1-4}$alkyl, C$_{1-4}$alkyl-amino-C$_{1-4}$alkyl, (C$_{1-4}$alkyl)$_2$-amino-C$_{1-4}$alkyl, amino-carbonyl, C$_{1-4}$alkyl-amino-carbonyl, (C$_{1-4}$alkyl)$_2$-amino-carbonyl, C$_{1-4}$alkyl-amino-carbonyl-C$_{1-4}$alkyl, (C$_{1-4}$alkyl)$_2$-amino-carbonyl-C$_{1-4}$alkyl, C$_{1-4}$alkyl-carbonyl-amino, C$_{1-4}$alkyl-carbonyl-amino-C$_{1-4}$alkyl, hydroxyl-C$_{1-4}$alkyl, C$_{1-4}$alkyl-carbonyl, C$_{1-4}$alkoxy, halo-C$_{1-4}$alkoxy, amino-C$_{1-4}$alkoxy, hydroxyl-C$_{1-4}$alkoxy, C$_{1-4}$alkyl-C$_{1-4}$alkoxy, C$_{1-4}$alkyl-amino-C$_{1-4}$alkoxy, (C$_{1-4}$alkyl)$_2$-amino-C$_{1-4}$alkoxy, C$_{1-4}$alkyl-carbonyl-amino-C$_{1-4}$alkoxy, C$_{1-4}$alkoxy-C$_{1-4}$alkoxy, C$_{1-4}$alkoxy-carbonyl, C$_{1-4}$alkoxy-carbonyl-amino, C$_{1-4}$alkoxy-carbonyl-amino-C$_{1-4}$alkoxy, C$_{2-4}$alkenyl, C$_{2-4}$alkenyl-amino-carbonyl, C$_{3-7}$cycloalkyl, C$_{3-7}$cycloalkyl-C$_{1-4}$alkoxy, C$_{3-7}$cycloalkenyl, heteroaryl, heteroaryl-C$_{1-4}$alkyl, heteroaryl-C$_{1-4}$alkyl-amino, heteroaryl-C$_{1-4}$alkyl-amino-carbonyl, heteroaryl-C$_{1-4}$alkyl-carbonyl-amino, heteroaryl-C$_{1-4}$alkyl-amino-carbonyl-C$_{1-4}$alkyl, heteroaryl-C$_{1-4}$alkyl-carbonyl-amino-C$_{1-4}$alkyl, heterocyclyl, heterocyclyl-C$_{1-4}$alkyl, heterocyclyl-C$_{1-4}$alkoxy, phenyl, or phenyl-C$_{1-4}$alkoxy,
wherein heteroaryl is a saturated monocyclic or bicyclic ring system having 1, 2, or 3 heteroatom ring members selected from N, O, and S,
wherein heterocyclyl is a saturated or partially unsaturated monocyclic or bicyclic ring system having 1, 2, or 3 heteroatom ring members selected from N, O, and S, and
wherein each instance of phenyl, heteroaryl or heterocyclyl is optionally substituted with 1, or 2 substituents each selected from R$_3$;
R$_2$ is halogen, hydroxyl, cyano, oxo, hydroxyl-imino, C$_{1-4}$alkyl, halo-C$_{1-4}$alkyl, amino, C$_{1-4}$alkyl-amino, (C$_{1-4}$alkyl)$_2$-amino, amino-C$_{1-4}$alkyl, C$_{1-4}$alkyl-amino-C$_{1-4}$alkyl, (C$_{1-4}$alkyl)$_2$-amino-C$_{1-4}$alkyl, amino-carbonyl, hydroxyl-C$_{1-4}$alkyl, C$_{1-4}$alkoxy, C$_{1-4}$alkoxy-carbonyl, C$_{2-4}$alkenyl, C$_{3-7}$cycloalkyl, or heterocyclyl-C$_{1-4}$alkyl,
wherein heterocyclyl is a saturated or partially unsaturated monocyclic or bicyclic ring system having 1, 2, or 3 heteroatom ring members selected from N, O, and S, and wherein each instance of heterocyclyl is optionally substituted with 1, or 2 substituents each selected from $R_3$;

$R_3$ is halogen, hydroxyl, nitro, oxo, hydroxyl-imino, $C_{1-4}$alkyl, halo-$C_{1-4}$alkyl, amino, $C_{1-4}$alkyl-amino, ($C_{1-4}$alkyl)$_2$-amino, amino-$C_{1-4}$alkyl, $C_{1-4}$alkyl-amino-$C_{1-4}$alkyl, ($C_{1-4}$alkyl)$_2$-amino-$C_{1-4}$alkyl, amino-carbonyl, $C_{1-4}$alkyl-amino-carbonyl, ($C_{1-4}$alkyl)$_2$-amino-carbonyl, $C_{1-4}$alkyl-amino-carbonyl-$C_{1-4}$alkyl, ($C_{1-4}$alkyl)$_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, ($C_{1-4}$alkyl)$_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, phenyl, or phenyl-$C_{1-4}$alkoxy;

$R_4$ is independently selected from halogen, $C_{1-4}$alkyl, hydroxyl-$C_{1-4}$alkyl, amino, $C_{1-4}$alkyl-amino, ($C_{1-4}$alkyl)$_2$-amino or hydroxyl-$C_{1-4}$alkyl-amino; and $R_5$ is hydrogen, $C_{1-4}$alkyl, or hydroxyl-$C_{1-4}$alkyl;

wherein a form of the compound is selected from the group consisting of a prodrug, salt, hydrate, solvate, clathrate, isotopologue, racemate, enantiomer, diastereomer, stereoisomer, polymorph and tautomer form thereof.

In some aspects, the iREMS is an endogenous iREMS. In other aspects, the iREMS is a non-endogenous iREMS.

In another aspect, provided herein is a method for modifying RNA splicing in order to produce a mature mRNA transcript having an iExon, the method comprising contacting a pre-mRNA transcript with a compound of Formula (I) or a form thereof, wherein the pre-mRNA transcript comprises two exons and an intron, wherein a first exon is upstream of the intron and a second exon is downstream of the intron, wherein the intron comprises in 5' to 3' order: a first 5' splice site, a first branch point, a first 3' splice site, an intronic recognition element for splicing modifier (iREMS), a second branch point, and a second 3' splice site, wherein the iREMS comprises an RNA sequence GAgurngn, wherein r is adenine or guanine and n is any nucleotide, wherein the pre-mRNA transcript is a pre-mRNA transcript of a gene that is selected from the genes listed in a table herein, and wherein Formula (I) is:

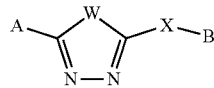
(I)

or a form thereof, wherein

W is CH=CH or S;

X is $CH_2$, $CH(C_{1-4}alkyl)$, $C(C_{1-4}alkyl)_2$, CH=CH, O, $NR_5$, or a bond;

A is aryl, heteroaryl, heterocyclyl, or $C_{9-10}$cycloalkyl, wherein aryl is selected from phenyl and naphthyl, each optionally substituted with 1, 2, 3, or 4 substituents each selected from $R_1$, wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from $R_1$, wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from $R_2$, and wherein $C_{9-10}$cycloalkyl is a saturated or partially unsaturated bicyclic ring system optionally substituted with 1, 2, 3, 4, or 5 substituents each selected from $R_2$;

B is heterocyclyl, wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from $R_4$;

$R_1$ is halogen, hydroxyl, cyano, $C_{1-4}$alkyl, halo-$C_{1-4}$alkyl, amino, $C_{1-4}$alkyl-amino, ($C_{1-4}$alkyl)$_2$-amino, amino-$C_{1-4}$alkyl, $C_{1-4}$alkyl-amino-$C_{1-4}$alkyl, ($C_{1-4}$alkyl)$_2$-amino-$C_{1-4}$alkyl, amino-carbonyl, $C_{1-4}$alkyl-amino-carbonyl, ($C_{1-4}$alkyl)$_2$-amino-carbonyl, $C_{1-4}$alkyl-amino-carbonyl-$C_{1-4}$alkyl, ($C_{1-4}$alkyl)$_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, ($C_{1-4}$alkyl)$_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, heterocyclyl-$C_{1-4}$alkoxy, phenyl, or phenyl-$C_{1-4}$alkoxy, wherein heteroaryl is a saturated monocyclic or bicyclic ring system having 1, 2, or 3 heteroatom ring members selected from N, O, and S, wherein heterocyclyl is a saturated or partially unsaturated monocyclic or bicyclic ring system having 1, 2, or 3 heteroatom ring members selected from N, O, and S, and wherein each instance of phenyl, heteroaryl or heterocyclyl is optionally substituted with 1, or 2 substituents each selected from $R_3$;

$R_2$ is halogen, hydroxyl, cyano, oxo, hydroxyl-imino, $C_{1-4}$alkyl, halo-$C_{1-4}$alkyl, amino, $C_{1-4}$alkyl-amino, ($C_{1-4}$alkyl)$_2$-amino, amino-$C_{1-4}$alkyl, $C_{1-4}$alkyl-amino-$C_{1-4}$alkyl, ($C_{1-4}$alkyl)$_2$-amino-$C_{1-4}$alkyl, amino-carbonyl, hydroxyl-$C_{1-4}$alkyl, $C_{1-4}$alkoxy, $C_{1-4}$alkoxy-carbonyl, $C_{2-4}$alkenyl, $C_{3-7}$cycloalkyl, or heterocyclyl-$C_{1-4}$alkyl, wherein heterocyclyl is a saturated or partially unsaturated monocyclic or bicyclic ring system having 1, 2, or 3 heteroatom ring members selected from N, O, and S, and wherein each instance of heterocyclyl is optionally substituted with 1, or 2 substituents each selected from $R_3$;

$R_3$ is halogen, hydroxyl, nitro, oxo, hydroxyl-imino, $C_{1-4}$alkyl, halo-$C_{1-4}$alkyl, amino, $C_{1-4}$alkyl-amino, ($C_{1-4}$alkyl)$_2$-amino, amino-$C_{1-4}$alkyl, $C_{1-4}$alkyl-amino-$C_{1-4}$alkyl, ($C_{1-4}$alkyl)$_2$-amino-$C_{1-4}$alkyl, amino-carbonyl, $C_{1-4}$alkyl-amino-carbonyl, ($C_{1-4}$alkyl)$_2$-amino-carbonyl, $C_{1-4}$alkyl-amino-carbonyl-$C_{1-4}$alkyl, ($C_{1-4}$alkyl)$_2$-amino-carbonyl- $C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}$alkyl$)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, phenyl, or phenyl-$C_{1-4}$alkoxy;

$R_4$ is independently selected from halogen, $C_{1-4}$alkyl, hydroxyl-$C_{1-4}$alkyl, amino, $C_{1-4}$alkyl-amino, $(C_{1-4}$alkyl$)_2$-amino or hydroxyl-$C_{1-4}$alkyl-amino; and $R_5$ is hydrogen, $C_{1-4}$alkyl, or hydroxyl-$C_{1-4}$alkyl;

wherein a form of the compound is selected from the group consisting of a prodrug, salt, hydrate, solvate, clathrate, isotopologue, racemate, enantiomer, diastereomer, stereoisomer, polymorph and tautomer form thereof.

In another aspect, provided herein is a method for modifying RNA splicing in order to modulate the amount of a mature mRNA transcript produced by a pre-mRNA transcript, the method comprising contacting the pre-mRNA transcript with a compound of Formula (I) or a form thereof, wherein the pre-mRNA transcript comprises two exons and an intron, wherein a first exon is upstream of the intron and a second exon is downstream of the intron, wherein the intron comprises a RNA nucleotide sequence comprising in 5' to 3' order: an intronic recognition element for splicing modifier (iREMS), a branch point, and a 3' splice site, wherein the iREMS comprises an RNA sequence GAgurngn, wherein r is adenine or guanine and n is any nucleotide, wherein the pre-mRNA transcript is a pre-mRNA transcript of a gene that is selected from the genes listed in a table herein, and wherein Formula (I) is:

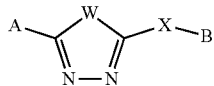
(I)

or a form thereof, wherein

W is CH=CH or S;

X is $CH_2$, $CH(C_{1-4}$alkyl), $C(C_{1-4}$alkyl$)_2$, CH=CH, O, $NR_5$, or a bond;

A is aryl, heteroaryl, heterocyclyl, or $C_{9-10}$cycloalkyl, wherein aryl is selected from phenyl and naphthyl, each optionally substituted with 1, 2, 3, or 4 substituents each selected from $R_1$, wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from $R_1$, wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from $R_2$, and wherein $C_{9-10}$cycloalkyl is a saturated or partially unsaturated bicyclic ring system optionally substituted with 1, 2, 3, 4, or 5 substituents each selected from $R_2$;

B is heterocyclyl, wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from $R_4$;

$R_1$ is halogen, hydroxyl, cyano, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, $C_{1-4}$alkyl-amino-carbonyl, $(C_{1-4}$alkyl$)_2$-amino-carbonyl, $C_{1-4}$alkyl-amino-carbonyl-$C_{1-4}$alkyl, $(C_{1-4}$alkyl$)_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C4$alkoxy, $(C_{1-4}$alkyl$)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, heterocyclyl-$C_{1-4}$alkoxy, phenyl, or phenyl-$C_{1-4}$alkoxy, wherein heteroaryl is a saturated monocyclic or bicyclic ring system having 1, 2, or 3 heteroatom ring members selected from N, O, and S, wherein heterocyclyl is a saturated or partially unsaturated monocyclic or bicyclic ring system having 1, 2, or 3 heteroatom ring members selected from N, O, and S, and wherein each instance of phenyl, heteroaryl or heterocyclyl is optionally substituted with 1, or 2 substituents each selected from $R_3$;

$R_2$ is halogen, hydroxyl, cyano, oxo, hydroxyl-imino, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, hydroxyl-$C_{1-4}$alkyl, $C_{1-4}$alkoxy, $C_{1-4}$alkoxy-carbonyl, $C_{2-4}$alkenyl, $C_{3-7}$cycloalkyl, or heterocyclyl-$C_{1-4}$alkyl, wherein heterocyclyl is a saturated or partially unsaturated monocyclic or bicyclic ring system having 1, 2, or 3 heteroatom ring members selected from N, O, and S, and wherein each instance of heterocyclyl is optionally substituted with 1, or 2 substituents each selected from $R_3$;

$R_3$ is halogen, hydroxyl, nitro, oxo, hydroxyl-imino, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, $C_{1-4}$alkyl-amino-carbonyl, $(C_{1-4}$alkyl$)_2$-amino-carbonyl, $C_{1-4}$alkyl-amino-carbonyl-$C_{1-4}$alkyl, $(C_{1-4}$alkyl$)_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}$alkyl$)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-C$_{1-4}$alkyl, heteroaryl-C$_{1-4}$alkyl-amino, heteroaryl-C$_{1-4}$alkyl-amino-carbonyl, heteroaryl-C$_{1-4}$alkyl-carbonyl-amino, heteroaryl-C$_{1-4}$alkyl-amino-carbonyl-C$_{1-4}$alkyl, heteroaryl-C$_{1-4}$alkyl-carbonyl-amino-C$_{1-4}$alkyl, heterocyclyl, heterocyclyl-C$_{1-4}$alkyl, phenyl, or phenyl-C$_{1-4}$alkoxy;

R$_4$ is independently selected from halogen, C$_{1-4}$alkyl, hydroxyl-C$_{1-4}$alkyl, amino, C$_{1-4}$alkyl-amino, (C$_{1-4}$alkyl)$_2$-amino or hydroxyl-C$_{1-4}$alkyl-amino; and R$_5$ is hydrogen, C$_{1-4}$alkyl, or hydroxyl-C$_{1-4}$alkyl;

wherein a form of the compound is selected from the group consisting of a prodrug, salt, hydrate, solvate, clathrate, isotopologue, racemate, enantiomer, diastereomer, stereoisomer, polymorph and tautomer form thereof.

In a specific aspect of the foregoing aspect, the intron further comprises in 5' to 3' order: a 5' splice site, a branch point, and a 3' splice site upstream of the iREMS.

In another aspect, provided herein is a method for modifying RNA splicing in order to modulate the amount of a mature mRNA transcript produced by a pre-mRNA transcript, the method comprising contacting the pre-mRNA transcript with a compound of Formula (I) or a form thereof, wherein the pre-mRNA transcript comprises three exons and two introns, wherein three exons and two introns are in the following order 5' to 3': a first exon, a first intron, a second exon, a second intron and a third exon, wherein the first intron comprises a RNA nucleotide sequence comprising in 5' to 3' order: a first 5' splice site, a first branch point and a first 3' splice site, wherein the second intron comprises a RNA nucleotide sequence comprising in 5' to 3' order: a second 5' splice site, an intronic recognition element for splicing modifier (iREMS), a second branch point, and a second 3' splice site, wherein the iREMS comprises an RNA sequence GAgurngn, wherein r is adenine or guanine and n is any nucleotide, wherein the pre-mRNA transcript is a pre-mRNA transcript of a gene that is selected from the genes listed in a table herein, and wherein Formula (I) is:

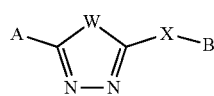

(I)

or a form thereof, wherein

W is CH=CH or S;

X is CH$_2$, CH(C$_{1-4}$alkyl), C(C$_{1-4}$alkyl)$_2$, CH=CH, O, NR$_5$, or a bond;

A is aryl, heteroaryl, heterocyclyl, or C$_{9-10}$cycloalkyl, wherein aryl is selected from phenyl and naphthyl, each optionally substituted with 1, 2, 3, or 4 substituents each selected from R$_1$, wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from R$_1$, wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from R$_2$, and wherein C$_{9-10}$cycloalkyl is a saturated or partially unsaturated bicyclic ring system optionally substituted with 1, 2, 3, 4, or 5 substituents each selected from R$_2$;

B is heterocyclyl, wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from R$_4$;

R$_1$ is halogen, hydroxyl, cyano, C$_{1-4}$alkyl, halo-C$_{1-4}$alkyl, amino, C$_{1-4}$alkyl-amino, (C$_{1-4}$alkyl)$_2$-amino, amino-C$_{1-4}$alkyl, C$_{1-4}$alkyl-amino-C$_{1-4}$alkyl, (C$_{1-4}$alkyl)$_2$-amino-C$_{1-4}$alkyl, amino-carbonyl, C$_{1-4}$alkyl-amino-carbonyl, (C$_{1-4}$alkyl)$_2$-amino-carbonyl, C$_{1-4}$alkyl-amino-carbonyl-C$_{1-4}$alkyl, (C$_{1-4}$alkyl)$_2$-amino-carbonyl-C$_{1-4}$alkyl, C$_{1-4}$alkyl-carbonyl-amino, C$_{1-4}$alkyl-carbonyl-amino-C$_{1-4}$alkyl, hydroxyl-C$_{1-4}$alkyl, C$_{1-4}$alkyl-carbonyl, C$_{1-4}$alkoxy, halo-C$_{1-4}$alkoxy, amino-C$_{1-4}$alkoxy, hydroxyl-C$_{1-4}$alkoxy, C$_{1-4}$alkyl-C$_{1-4}$alkoxy, C$_{1-4}$alkyl-amino-C$_{1-4}$alkoxy, (C$_{1-4}$alkyl)$_2$-amino-C$_{1-4}$alkoxy, C$_{1-4}$alkyl-carbonyl-amino-C$_{1-4}$alkoxy, C$_{1-4}$alkoxy-C$_{1-4}$alkoxy, C$_{1-4}$alkoxy-carbonyl, C$_{1-4}$alkoxy-carbonyl-amino, C$_{1-4}$alkoxy-carbonyl-amino-C$_{1-4}$alkoxy, C$_{2-4}$alkenyl, C$_{2-4}$alkenyl-amino-carbonyl, C$_{3-7}$cycloalkyl, C$_{3-7}$cycloalkyl-C$_{1-4}$alkoxy, C$_{3-7}$cycloalkenyl, heteroaryl, heteroaryl-C$_{1-4}$alkyl, heteroaryl-C$_{1-4}$alkyl-amino, heteroaryl-C$_{1-4}$alkyl-amino-carbonyl, heteroaryl-C$_{1-4}$alkyl-carbonyl-amino, heteroaryl-C$_{1-4}$alkyl-amino-carbonyl-C$_{1-4}$alkyl, heteroaryl-C$_{1-4}$alkyl-carbonyl-amino-C$_{1-4}$alkyl, heterocyclyl, heterocyclyl-C$_{1-4}$alkyl, heterocyclyl-C$_{1-4}$alkoxy, phenyl, or phenyl-C$_{1-4}$alkoxy, wherein heteroaryl is a saturated monocyclic or bicyclic ring system having 1, 2, or 3 heteroatom ring members selected from N, O, and S, wherein heterocyclyl is a saturated or partially unsaturated monocyclic or bicyclic ring system having 1, 2, or 3 heteroatom ring members selected from N, O, and S, and wherein each instance of phenyl, heteroaryl or heterocyclyl is optionally substituted with 1, or 2 substituents each selected from R$_3$;

R$_2$ is halogen, hydroxyl, cyano, oxo, hydroxyl-imino, C$_{1-4}$alkyl, halo-C$_{1-4}$alkyl, amino, C$_{1-4}$alkyl-amino, (C$_{1-4}$alkyl)$_2$-amino, amino-C$_{1-4}$alkyl, C$_{1-4}$alkyl-amino-C$_{1-4}$alkyl, (C$_{1-4}$alkyl)$_2$-amino-C$_{1-4}$alkyl, amino-carbonyl, hydroxyl-C$_{1-4}$alkyl, C$_{1-4}$alkoxy, C$_{1-4}$alkoxy-carbonyl, C$_{2-4}$alkenyl, C$_{3-7}$cycloalkyl, or heterocyclyl-C$_{1-4}$alkyl, wherein heterocyclyl is a saturated or partially unsaturated monocyclic or bicyclic ring system having 1, 2, or 3 heteroatom ring members selected from N, O, and S, and wherein each instance of heterocyclyl is optionally substituted with 1, or 2 substituents each selected from R$_3$;

R$_3$ is halogen, hydroxyl, nitro, oxo, hydroxyl-imino, C$_{1-4}$alkyl, halo-C$_{1-4}$alkyl, amino, C$_{1-4}$alkyl-amino, (C$_{1-4}$alkyl)$_2$-amino, amino-C$_{1-4}$alkyl, C$_{1-4}$alkyl-amino-C$_{1-4}$alkyl, (C$_{1-4}$alkyl)$_2$-amino-C$_{1-4}$alkyl, amino-carbonyl, C$_{1-4}$alkyl-amino-carbonyl, (C$_{1-4}$alkyl)$_2$-amino-carbonyl, C$_{1-4}$alkyl-amino-carbonyl-C$_{1-4}$alkyl, (C$_{1-4}$alkyl)$_2$-amino-carbonyl-C$_{1-4}$alkyl, C$_{1-4}$alkyl-carbonyl-amino, C$_{1-4}$alkyl-carbonyl-amino-C$_{1-4}$alkyl, hydroxyl-C$_{1-4}$alkyl, C$_{1-4}$alkyl-carbonyl, C$_{1-4}$alkoxy, halo-C$_{1-4}$alkoxy, amino-C$_{1-4}$alkoxy, hydroxyl-C$_{1-4}$alkoxy, C$_{1-4}$alkyl-C$_{1-4}$alkoxy, C$_{1-4}$alkyl-amino-C$_{1-4}$alkoxy, (C$_{1-4}$alkyl)$_2$-amino-C$_{1-4}$alkoxy, C$_{1-4}$alkyl-carbonyl-amino-C$_{1-4}$alkoxy, C$_{1-4}$alkoxy-C$_{1-4}$alkoxy, C$_{1-4}$alkoxy-carbonyl, C$_{1-4}$alkoxy-carbonyl-amino, C$_{1-4}$alkoxy-carbonyl-amino-C$_{1-4}$alkoxy, C$_{2-4}$alkenyl, C$_{2-4}$alkenyl-amino-carbonyl, C$_{3-7}$cycloalkyl, C$_{3-7}$cycloalkyl-C$_{1-4}$alkoxy, C$_{3-7}$cycloalkenyl, heteroaryl, heteroaryl-C$_{1-4}$alkyl, heteroaryl-C$_{1-4}$alkyl-amino, heteroaryl-C$_{1-4}$alkyl-amino-carbonyl, heteroaryl-C$_{1-4}$alkyl-carbonyl-amino, heteroaryl-C$_{1-4}$alkyl-amino-carbonyl- C$_{1-4}$alkyl, heteroaryl-C$_{1-4}$alkyl-carbonyl-amino-C$_{1-4}$alkyl, heterocyclyl, heterocyclyl-C$_{1-4}$alkyl, phenyl, or phenyl-C$_{1-4}$alkoxy;

R$_4$ is independently selected from halogen, C$_{1-4}$alkyl, hydroxyl-C$_{1-4}$alkyl, amino, C$_{1-4}$alkyl-amino, (C$_{1-4}$alkyl)$_2$-amino or hydroxyl-C$_{1-4}$alkyl-amino; and R$_5$ is hydrogen, C$_{1-4}$alkyl, or hydroxyl-C$_{1-4}$alkyl;

wherein a form of the compound is selected from the group consisting of a prodrug, salt, hydrate, solvate, clathrate, isotopologue, racemate, enantiomer, diastereomer, stereoisomer, polymorph and tautomer form thereof.

In another aspect, provided herein is a method for modifying RNA splicing in order to produce a mature mRNA transcript having an iExon, the method comprising contacting a pre-mRNA transcript with a compound of Formula (I) or a form thereof, wherein the pre-mRNA transcript comprises two exons and an intron, wherein a first exon is upstream of the intron and a second exon is downstream of the intron, wherein the intron comprises in 5' to 3' order: a first 5' splice site, a first branch point, a first 3' splice site, an intronic recognition element for splicing modifier (iREMS), a second branch point, and a second 3' splice site, wherein the iREMS comprises an RNA sequence GAgurngn, wherein r is adenine or guanine and n is any nucleotide, and wherein Formula (I) is:

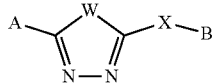

(I)

or a form thereof, wherein

W is CH=CH or S;

X is CH$_2$, CH(C$_{1-4}$alkyl), C(C$_{1-4}$alkyl)$_2$, CH=CH, O, NR$_5$, or a bond;

A is aryl, heteroaryl, heterocyclyl, or C$_{9-10}$cycloalkyl, wherein aryl is selected from phenyl and naphthyl, each optionally substituted with 1, 2, 3, or 4 substituents each selected from R$_1$, wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from R$_1$, wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from R$_2$, and wherein C$_{9-10}$cycloalkyl is a saturated or partially unsaturated bicyclic ring system optionally substituted with 1, 2, 3, 4, or 5 substituents each selected from R$_2$;

B is heterocyclyl, wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from R$_4$;

R$_1$ is halogen, hydroxyl, cyano, C$_{1-4}$alkyl, halo-C$_{1-4}$alkyl, amino, C$_{1-4}$alkyl-amino, (C$_{1-4}$alkyl)$_2$-amino, amino-C$_{1-4}$alkyl, C$_{1-4}$alkyl-amino-C$_{1-4}$alkyl, (C$_{1-4}$alkyl)$_2$-amino-C$_{1-4}$alkyl, amino-carbonyl, C$_{1-4}$alkyl-amino-carbonyl, (C$_{1-4}$alkyl)$_2$-amino-carbonyl, C$_{1-4}$alkyl-amino-carbonyl-C$_{1-4}$alkyl, (C$_{1-4}$alkyl)$_2$-amino-carbonyl-C$_{1-4}$alkyl, C$_{1-4}$alkyl-carbonyl-amino, C$_{1-4}$alkyl-carbonyl-amino-C$_{1-4}$alkyl, hydroxyl-C$_{1-4}$alkyl, C$_{1-4}$alkyl-carbonyl, C$_{1-4}$alkoxy, halo-C$_{1-4}$alkoxy, amino-C$_{1-4}$alkoxy, hydroxyl-C$_{1-4}$alkoxy, C$_{1-4}$alkyl-C$_{1-4}$alkoxy, C$_{1-4}$alkyl-amino-C$_{1-4}$alkoxy, (C$_{1-4}$alkyl)$_2$-amino-C$_{1-4}$alkoxy, C$_{1-4}$alkyl-carbonyl-amino-C$_{1-4}$alkoxy, C$_{1-4}$alkoxy-C$_{1-4}$alkoxy, C$_{1-4}$alkoxy-carbonyl, C$_{1-4}$alkoxy-carbonyl-amino, C$_{1-4}$alkoxy-carbonyl-amino-C$_{1-4}$alkoxy, C$_{2-4}$alkenyl, C$_{2-4}$alkenyl-amino-carbonyl, C$_{3-7}$cycloalkyl, C$_{3-7}$cycloalkyl-C$_{1-4}$alkoxy, C$_{3-7}$cycloalkenyl, heteroaryl, heteroaryl-C$_{1-4}$alkyl, heteroaryl-C$_{1-4}$alkyl-amino, heteroaryl-C$_{1-4}$alkyl-amino-carbonyl, heteroaryl-C$_{1-4}$alkyl-carbonyl-amino, heteroaryl-C$_{1-4}$alkyl-amino-carbonyl-C$_{1-4}$alkyl, heteroaryl-C$_{1-4}$alkyl-carbonyl-amino-C$_{1-4}$alkyl, heterocyclyl, heterocyclyl-C$_{1-4}$alkyl, heterocyclyl-C$_{1-4}$alkoxy, phenyl, or phenyl-C$_{1-4}$alkoxy, wherein heteroaryl is a saturated monocyclic or bicyclic ring system having 1, 2, or 3 heteroatom ring members selected from N, O, and S, wherein heterocyclyl is a saturated or partially unsaturated monocyclic or bicyclic ring system having 1, 2, or 3 heteroatom ring members selected from N, O, and S, and wherein each instance of phenyl, heteroaryl or heterocyclyl is optionally substituted with 1, or 2 substituents each selected from R$_3$;

R$_2$ is halogen, hydroxyl, cyano, oxo, hydroxyl-imino, C$_{1-4}$alkyl, halo-C$_{1-4}$alkyl, amino, C$_{1-4}$alkyl-amino, (C$_{1-4}$alkyl)$_2$-amino, amino-C$_{1-4}$alkyl, C$_{1-4}$alkyl-amino-C$_{1-4}$alkyl, (C$_{1-4}$alkyl)$_2$-amino-C$_{1-4}$alkyl, amino-carbonyl, hydroxyl-C$_{1-4}$alkyl, C$_{1-4}$alkoxy, C$_{1-4}$alkoxy-carbonyl, C$_{2-4}$alkenyl, C$_{3-7}$cycloalkyl, or heterocyclyl-C$_{1-4}$alkyl, wherein heterocyclyl is a saturated or partially unsaturated monocyclic or bicyclic ring system having 1, 2, or 3 heteroatom ring members selected from N, O, and S, and wherein each instance of heterocyclyl is optionally substituted with 1, or 2 substituents each selected from R$_3$;

R$_3$ is halogen, hydroxyl, nitro, oxo, hydroxyl-imino, C$_{1-4}$alkyl, halo-C$_{1-4}$alkyl, amino, C$_{1-4}$alkyl-amino, (C$_{1-4}$alkyl)$_2$-amino, amino-C$_{1-4}$alkyl, C$_{1-4}$alkyl-amino-C$_{1-4}$alkyl, (C$_{1-4}$alkyl)$_2$-amino-C$_{1-4}$alkyl, amino-carbonyl, C$_{1-4}$alkyl-amino-carbonyl, (C$_{1-4}$alkyl)$_2$-amino-carbonyl, C$_{1-4}$alkyl-amino-carbonyl-C$_{1-4}$alkyl, (C$_{1-4}$alkyl)$_2$-amino-carbonyl-C$_{1-4}$alkyl, C$_{1-4}$alkyl-carbonyl-amino, C$_{1-4}$alkyl-carbonyl-amino-C$_{1-4}$alkyl, hydroxyl-C$_{1-4}$alkyl, C$_{1-4}$alkyl-carbonyl, C$_{1-4}$alkoxy, halo-C$_{1-4}$alkoxy, amino-C$_{1-4}$alkoxy, hydroxyl-C$_{1-4}$alkoxy, C$_{1-4}$alkyl-C$_{1-4}$alkoxy, C$_{1-4}$alkyl-amino-C$_{1-4}$alkoxy, (C$_{1-4}$alkyl)$_2$-amino-C$_{1-4}$alkoxy, C$_{1-4}$alkyl-carbonyl-amino-C$_{1-4}$alkoxy, C$_{1-4}$alkoxy-C$_{1-4}$alkoxy, C$_{1-4}$alkoxy-carbonyl, C$_{1-4}$alkoxy-carbonyl-amino, C$_{1-4}$alkoxy-carbonyl-amino-C$_{1-4}$alkoxy, C$_{2-4}$alkenyl, C$_{2-4}$alkenyl-amino-carbonyl, C$_{3-7}$cycloalkyl, C$_{3-7}$cycloalkyl-C$_{1-4}$alkoxy, C$_{3-7}$cycloalkenyl, heteroaryl, heteroaryl-C$_{1-4}$alkyl, heteroaryl-C$_{1-4}$alkyl-amino, heteroaryl-C$_{1-4}$alkyl-amino-carbonyl, heteroaryl-C$_{1-4}$alkyl-carbonyl-amino, heteroaryl-C$_{1-4}$alkyl-amino-carbonyl-C$_{1-4}$alkyl, heteroaryl-C$_{1-4}$alkyl-carbonyl-amino-C$_{1-4}$alkyl, heterocyclyl, heterocyclyl-C$_{1-4}$alkyl, phenyl, or phenyl-C$_{1-4}$alkoxy;

R$_4$ is independently selected from halogen, C$_{1-4}$alkyl, hydroxyl-C$_{1-4}$alkyl, amino, C$_{1-4}$alkyl-amino, (C$_{1-4}$alkyl)$_2$-amino or hydroxyl-C$_{1-4}$alkyl-amino; and R$_5$ is hydrogen, C$_{1-4}$alkyl, or hydroxyl-C$_{1-4}$alkyl;

wherein a form of the compound is selected from the group consisting of a prodrug, salt, hydrate, solvate, clathrate, isotopologue, racemate, enantiomer, diastereomer, stereoisomer, polymorph and tautomer form thereof.

In another aspect, provided herein is a method for modifying RNA splicing in order to modulate the amount of a mature mRNA transcript produced by a pre-mRNA transcript, the method comprising contacting the pre-mRNA transcript with a compound of Formula (I) or a form thereof, wherein the pre-mRNA transcript comprises two exons and an intron, wherein a first exon is upstream of the intron and a second exon is downstream of the intron, wherein the intron comprises a RNA nucleotide sequence comprising in 5' to 3' order: an intronic recognition element for splicing modifier (iREMS), a branch point, and a 3' splice site, wherein the iREMS comprises an RNA sequence GAgurngn, wherein r is adenine or guanine and n is any nucleotide, and wherein Formula (I) is:

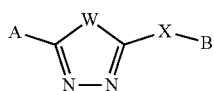

(I)

or a form thereof, wherein
W is CH=CH or S;
X is $CH_2$, $CH(C_{1-4}alkyl)$, $C(C_{1-4}alkyl)_2$, CH=CH, O, $NR_5$, or a bond;
A is aryl, heteroaryl, heterocyclyl, or $C_{9-10}$cycloalkyl,
wherein aryl is selected from phenyl and naphthyl, each optionally substituted with 1, 2, 3, or 4 substituents each selected from $R_1$,
wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from $R_1$,
wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from $R_2$, and
wherein $C_{9-10}$cycloalkyl is a saturated or partially unsaturated bicyclic ring system optionally substituted with 1, 2, 3, 4, or 5 substituents each selected from $R_2$;
B is heterocyclyl,
wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from $R_4$;
$R_1$ is halogen, hydroxyl, cyano, $C_{1-4}$alkyl, halo-$C_{1-4}$alkyl, amino, $C_{1-4}$alkyl-amino, $(C_{1-4}alkyl)_2$-amino, amino-$C_{1-4}$alkyl, $C_{1-4}$alkyl-amino-$C_{1-4}$alkyl, $(C_{1-4}alkyl)_2$-amino-$C_{1-4}$alkyl, amino-carbonyl, $C_{1-4}$alkyl-amino-carbonyl, $(C_{1-4}alkyl)_2$-amino-carbonyl, $C_{1-4}$alkyl-amino-carbonyl-$C_{1-4}$alkyl, $(C_{1-4}alkyl)_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}alkyl)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C4$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, heterocyclyl-$C_{1-4}$alkoxy, phenyl, or phenyl-$C_{1-4}$alkoxy,
wherein heteroaryl is a saturated monocyclic or bicyclic ring system having 1, 2, or 3 heteroatom ring members selected from N, O, and S,
wherein heterocyclyl is a saturated or partially unsaturated monocyclic or bicyclic ring system having 1, 2, or 3 heteroatom ring members selected from N, O, and S, and
wherein each instance of phenyl, heteroaryl or heterocyclyl is optionally substituted with 1, or 2 substituents each selected from $R_3$;
$R_2$ is halogen, hydroxyl, cyano, oxo, hydroxyl-imino, $C_{1-4}$alkyl, halo-$C_{1-4}$alkyl, amino, $C_{1-4}$alkyl-amino, $(C_{1-4}alkyl)_2$-amino, amino-$C_{1-4}$alkyl, $C_{1-4}$alkyl-amino-$C_{1-4}$alkyl, $(C_{1-4}alkyl)_2$-amino-$C_{1-4}$alkyl, amino-carbonyl, hydroxyl-$C_{1-4}$alkyl, $C_{1-4}$alkoxy, $C_{1-4}$alkoxy-carbonyl, $C_{2-4}$alkenyl, $C_{3-7}$cycloalkyl, or heterocyclyl-$C_{1-4}$alkyl,
wherein heterocyclyl is a saturated or partially unsaturated monocyclic or bicyclic ring system having 1, 2, or 3 heteroatom ring members selected from N, O, and S, and
wherein each instance of heterocyclyl is optionally substituted with 1, or 2 substituents each selected from $R_3$;
$R_3$ is halogen, hydroxyl, nitro, oxo, hydroxyl-imino, $C_{1-4}$alkyl, halo-$C_{1-4}$alkyl, amino, $C_{1-4}$alkyl-amino, $(C_{1-4}alkyl)_2$-amino, amino-$C_{1-4}$alkyl, $C_{1-4}$alkyl-amino-$C_{1-4}$alkyl, $(C_{1-4}alkyl)_2$-amino-$C_{1-4}$alkyl, amino-carbonyl, $C_{1-4}$alkyl-amino-carbonyl, $(C_{1-4}alkyl)_2$-amino-carbonyl, $C_{1-4}$alkyl-amino-carbonyl-$C_{1-4}$alkyl, $(C_{1-4}alkyl)_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}alkyl)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, phenyl, or phenyl-$C_{1-4}$alkoxy;
$R_4$ is independently selected from halogen, $C_{1-4}$alkyl, hydroxyl-$C_{1-4}$alkyl, amino, $C_{1-4}$alkyl-amino, $(C_{1-4}alkyl)_2$-amino or hydroxyl-$C_{1-4}$alkyl-amino; and
$R_5$ is hydrogen, $C_{1-4}$alkyl, or hydroxyl-$C_{1-4}$alkyl;
wherein a form of the compound is selected from the group consisting of a prodrug, salt, hydrate, solvate, clathrate, isotopologue, racemate, enantiomer, diastereomer, stereoisomer, polymorph and tautomer form thereof.

In a specific aspect of the foregoing aspect, the intron further comprises in 5' to 3' order: a 5' splice site, a branch point, and a 3' splice site upstream of the iREMS.

In another aspect, provided herein is a method for modifying RNA splicing in order to modulate the amount of a mature mRNA transcript produced by a pre-mRNA transcript, the method comprising contacting the pre-mRNA transcript with a compound of Formula (I) or a form thereof, wherein the pre-mRNA transcript comprises three exons and two introns, wherein three exons and two introns are in the following order 5' to 3': a first exon, a first intron, a second exon, a second intron and a third exon, wherein the first intron comprises a RNA nucleotide sequence comprising in 5' to 3' order: a first 5' splice site, a first branch point and a first 3' splice site, wherein the second intron comprises a RNA nucleotide sequence comprising in 5' to 3' order: a second 5' splice site, an intronic recognition element for splicing modifier (iREMS), a second branch point, and a second 3' splice site, wherein the iREMS comprises an RNA sequence GAgurngn, wherein r is adenine or guanine and n is any nucleotide, and wherein Formula (I) is:

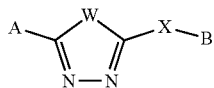

or a form thereof, wherein
W is CH=CH or S;
X is $CH_2$, $CH(C_{1-4}alkyl)$, $C(C_{1-4}alkyl)_2$, CH=CH, O, $NR_5$, or a bond;
A is aryl, heteroaryl, heterocyclyl, or $C_{9-10}$cycloalkyl,
wherein aryl is selected from phenyl and naphthyl, each optionally substituted with 1, 2, 3, or 4 substituents each selected from $R_1$,
wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from $R_1$,
wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from $R_2$, and
wherein $C_{9-10}$cycloalkyl is a saturated or partially unsaturated bicyclic ring system optionally substituted with 1, 2, 3, 4, or 5 substituents each selected from $R_2$;
B is heterocyclyl,
wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from $R_4$;
$R_1$ is halogen, hydroxyl, cyano, $C_{1-4}$alkyl, halo-$C_{1-4}$alkyl, amino, $C_{1-4}$alkyl-amino, $(C_{1-4}alkyl)_2$-amino, amino-$C_{1-4}$alkyl, $C_{1-4}$alkyl-amino-$C_{1-4}$alkyl, $(C_{1-4}alkyl)_2$-amino-$C_{1-4}$alkyl, amino-carbonyl, $C_{1-4}$alkyl-amino-carbonyl, $(C_{1-4}alkyl)_2$-amino-carbonyl, $C_{1-4}$alkyl-amino-carbonyl-$C_{1-4}$alkyl, $(C_{1-4}alkyl)_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}alkyl)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, heterocyclyl-$C_{1-4}$alkoxy, phenyl, or phenyl-$C_{1-4}$alkoxy,
wherein heteroaryl is a saturated monocyclic or bicyclic ring system having 1, 2, or 3 heteroatom ring members selected from N, O, and S,
wherein heterocyclyl is a saturated or partially unsaturated monocyclic or bicyclic ring system having 1, 2, or 3 heteroatom ring members selected from N, O, and S, and
wherein each instance of phenyl, heteroaryl or heterocyclyl is optionally substituted with 1, or 2 substituents each selected from $R_3$;
$R_2$ is halogen, hydroxyl, cyano, oxo, hydroxyl-imino, $C_{1-4}$alkyl, halo-$C_{1-4}$alkyl, amino, $C_{1-4}$alkyl-amino, $(C_{1-4}alkyl)_2$-amino, amino-$C_{1-4}$alkyl, $C_{1-4}$alkyl-amino-$C_{1-4}$alkyl, $(C_{1-4}alkyl)_2$-amino-$C_{1-4}$alkyl, amino-carbonyl, hydroxyl-$C_{1-4}$alkyl, $C_{1-4}$alkoxy, $C_{1-4}$alkoxy-carbonyl, $C_{2-4}$alkenyl, $C_{3-7}$cycloalkyl, or heterocyclyl-$C_{1-4}$alkyl,
wherein heterocyclyl is a saturated or partially unsaturated monocyclic or bicyclic ring system having 1, 2, or 3 heteroatom ring members selected from N, O, and S, and
wherein each instance of heterocyclyl is optionally substituted with 1, or 2 substituents each selected from $R_3$;
$R_3$ is halogen, hydroxyl, nitro, oxo, hydroxyl-imino, $C_{1-4}$alkyl, halo-$C_{1-4}$alkyl, amino, $C_{1-4}$alkyl-amino, $(C_{1-4}alkyl)_2$-amino, amino-$C_{1-4}$alkyl, $C_{1-4}$alkyl-amino-$C_{1-4}$alkyl, $(C_{1-4}alkyl)_2$-amino-$C_{1-4}$alkyl, amino-carbonyl, $C_{1-4}$alkyl-amino-carbonyl, $(C_{1-4}alkyl)_2$-amino-carbonyl, $C_{1-4}$alkyl-amino-carbonyl-$C_{1-4}$alkyl, $(C_{1-4}alkyl)_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}alkyl)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, phenyl, or phenyl-$C_{1-4}$alkoxy;
$R_4$ is independently selected from halogen, $C_{1-4}$alkyl, hydroxyl-$C_{1-4}$alkyl, amino, $C_{1-4}$alkyl-amino, $(C_{1-4}alkyl)_2$-amino or hydroxyl-$C_{1-4}$alkyl-amino; and
$R_5$ is hydrogen, $C_{1-4}$alkyl, or hydroxyl-$C_{1-4}$alkyl;
wherein a form of the compound is selected from the group consisting of a prodrug, salt, hydrate, solvate, clathrate, isotopologue, racemate, enantiomer, diastereomer, stereoisomer, polymorph and tautomer form thereof.

In a specific aspect, the pre-mRNA transcript is in a cell or a lysate of the cell and the method comprises contacting the compound with the cell or cell lysate. In a specific aspect, the method modulates the amount and/or modifies the type of a protein produced from the mature mRNA transcript and produced in the cell or lysate of the cell.

In a specific aspect, the method comprises administering the compound to a subject. In a specific aspect, the method modulates the amount and/or modifies the type of a protein produced from the mature mRNA transcript and produced in the subject. In one aspect, the subject is a non-human subject. In another aspect, the subject is a human subject.

In a specific aspect, the mature mRNA transcript encodes a detectable reporter protein.

In another aspect, provided herein is a method for modifying RNA splicing in order to prevent or treat a disease or disorder in which a change in the level of expression of one, two, three or more RNA isoforms encoded by a gene is beneficial to the prevention or treatment of the disease, the method comprising administering a compound described herein to a subject in need thereof, wherein the one, two, three or more RNA isoforms are produced from modifying RNA splicing of a pre-mRNA transcript comprising two exons and an intron, wherein a first exon is upstream of the intron and a second exon is downstream of the intron, wherein the intron comprises in 5' to 3' order: a first 5' splice site, a first branch point, a first 3' splice site, an intronic recognition element for splicing modifier (iREMS), a second branch point, and a second 3' splice site, wherein the iREMS comprises an RNA sequence GAgurngn, wherein r is adenine or guanine and n is any nucleotide, and wherein Formula (I) is:

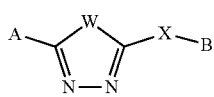

(I)

or a form thereof, wherein
W is CH=CH or S;
X is $CH_2$, $CH(C_{1-4}alkyl)$, $C(C_{1-4}alkyl)_2$, CH=CH, O, $NR_5$, or a bond;
A is aryl, heteroaryl, heterocyclyl, or $C_{9-10}$cycloalkyl,
wherein aryl is selected from phenyl and naphthyl, each optionally substituted with 1, 2, 3, or 4 substituents each selected from $R_1$,
wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from $R_1$,
wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from $R_2$, and
wherein $C_{9-10}$cycloalkyl is a saturated or partially unsaturated bicyclic ring system optionally substituted with 1, 2, 3, 4, or 5 substituents each selected from $R_2$;
B is heterocyclyl,
wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from $R_4$;
$R_1$ is halogen, hydroxyl, cyano, $C_{1-4}$alkyl, halo-$C_{1-4}$alkyl, amino, $C_{1-4}$alkyl-amino, $(C_{1-4}alkyl)_2$-amino, amino-$C_{1-4}$alkyl, $C_{1-4}$alkyl-amino-$C_{1-4}$alkyl, $(C_{1-4}alkyl)_2$-amino-$C_{1-4}$alkyl, amino-carbonyl, $C_{1-4}$alkyl-amino-carbonyl, $(C_{1-4}alkyl)_2$-amino-carbonyl, $C_{1-4}$alkyl-amino-carbonyl-$C_{1-4}$alkyl, $(C_{1-4}alkyl)_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}alkyl)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, heterocyclyl-$C_{1-4}$alkoxy, phenyl, or phenyl-$C_{1-4}$alkoxy,
wherein heteroaryl is a saturated monocyclic or bicyclic ring system having 1, 2, or 3 heteroatom ring members selected from N, O, and S,
wherein heterocyclyl is a saturated or partially unsaturated monocyclic or bicyclic ring system having 1, 2, or 3 heteroatom ring members selected from N, O, and S, and
wherein each instance of phenyl, heteroaryl or heterocyclyl is optionally substituted with 1, or 2 substituents each selected from $R_3$;
$R_2$ is halogen, hydroxyl, cyano, oxo, hydroxyl-imino, $C_{1-4}$alkyl, halo-$C_{1-4}$alkyl, amino, $C_{1-4}$alkyl-amino, $(C_{1-4}alkyl)_2$-amino, amino-$C_{1-4}$alkyl, $C_{1-4}$alkyl-amino-$C_{1-4}$alkyl, $(C_{1-4}alkyl)_2$-amino-$C_{1-4}$alkyl, amino-carbonyl, hydroxyl-$C_{1-4}$alkyl, $C_{1-4}$alkoxy, $C_{1-4}$alkoxy-carbonyl, $C_{2-4}$alkenyl, $C_{3-7}$cycloalkyl, or heterocyclyl-$C_{1-4}$alkyl,
wherein heterocyclyl is a saturated or partially unsaturated monocyclic or bicyclic ring system having 1, 2, or 3 heteroatom ring members selected from N, O, and S, and
wherein each instance of heterocyclyl is optionally substituted with 1, or 2 substituents each selected from $R_3$;
$R_3$ is halogen, hydroxyl, nitro, oxo, hydroxyl-imino, $C_{1-4}$alkyl, halo-$C_{1-4}$alkyl, amino, $C_{1-4}$alkyl-amino, $(C_{1-4}alkyl)_2$-amino, amino-$C_{1-4}$alkyl, $C_{1-4}$alkyl-amino-$C_{1-4}$alkyl, $(C_{1-4}alkyl)_2$-amino-$C_{1-4}$alkyl, amino-carbonyl, $C_{1-4}$alkyl-amino-carbonyl, $(C_{1-4}alkyl)_2$-amino-carbonyl, $C_{1-4}$alkyl-amino-carbonyl-$C_{1-4}$alkyl, $(C_{1-4}alkyl)_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}alkyl)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, phenyl, or phenyl-$C_{1-4}$alkoxy;
$R_4$ is independently selected from halogen, $C_{1-4}$alkyl, hydroxyl-$C_{1-4}$alkyl, amino, $C_{1-4}$alkyl-amino, $(C_{1-4}alkyl)_2$-amino or hydroxyl-$C_{1-4}$alkyl-amino; and
$R_5$ is hydrogen, $C_{1-4}$alkyl, or hydroxyl-$C_{1-4}$alkyl;
wherein a form of the compound is selected from the group consisting of a prodrug, salt, hydrate, solvate, clathrate, isotopologue, racemate, enantiomer, diastereomer, stereoisomer, polymorph and tautomer form thereof.

In another aspect, provided herein is a method for modifying RNA splicing in order to prevent or treat a disease or disorder in which a change in the level of expression of one, two, three or more RNA isoforms encoded by a gene is beneficial to the prevention or treatment of the disease, the method comprising administering a compound described herein to a subject in need thereof, wherein the one, two, three or more RNA isoforms are produced from a pre-mRNA transcript comprising two exons and an intron, wherein a first exon is upstream of the intron and a second exon is downstream of the intron, wherein the intron comprises a RNA nucleotide sequence comprising in 5' to 3' order: an intronic recognition element for splicing modifier (iREMS), a branch point, and a 3' splice site, wherein the iREMS comprises an RNA sequence GAgurngn, wherein r is adenine or guanine and n is any nucleotide, and wherein Formula (I) is:

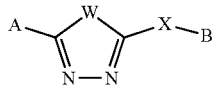

or a form thereof, wherein
W is CH=CH or S;
X is $CH_2$, $CH(C_{1-4}alkyl)$, $C(C_{1-4}alkyl)_2$, CH=CH, O, $NR_5$, or a bond;
A is aryl, heteroaryl, heterocyclyl, or $C_{9-10}$cycloalkyl,
  wherein aryl is selected from phenyl and naphthyl, each optionally substituted with 1, 2, 3, or 4 substituents each selected from $R_1$,
  wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from $R_1$,
  wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from $R_2$, and
  wherein $C_{9-10}$cycloalkyl is a saturated or partially unsaturated bicyclic ring system optionally substituted with 1, 2, 3, 4, or 5 substituents each selected from $R_2$;
B is heterocyclyl,
  wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from $R_4$;
$R_1$ is halogen, hydroxyl, cyano, $C_{1-4}$alkyl, halo-$C_{1-4}$alkyl, amino, $C_{1-4}$alkyl-amino, $(C_{1-4}alkyl)_2$-amino, amino-$C_{1-4}$alkyl, $C_{1-4}$alkyl-amino-$C_{1-4}$alkyl, $(C_{1-4}alkyl)_2$-amino-$C_{1-4}$alkyl, amino-carbonyl, $C_{1-4}$alkyl-amino-carbonyl, $(C_{1-4}alkyl)_2$-amino-carbonyl, $C_{1-4}$alkyl-amino-carbonyl-$C_{1-4}$alkyl, $(C_{1-4}alkyl)_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}alkyl)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, heterocyclyl-$C_{1-4}$alkoxy, phenyl, or phenyl-$C_{1-4}$alkoxy,
  wherein heteroaryl is a saturated monocyclic or bicyclic ring system having 1, 2, or 3 heteroatom ring members selected from N, O, and S,
  wherein heterocyclyl is a saturated or partially unsaturated monocyclic or bicyclic ring system having 1, 2, or 3 heteroatom ring members selected from N, O, and S, and
  wherein each instance of phenyl, heteroaryl or heterocyclyl is optionally substituted with 1, or 2 substituents each selected from $R_3$;
$R_2$ is halogen, hydroxyl, cyano, oxo, hydroxyl-imino, $C_{1-4}$alkyl, halo-$C_{1-4}$alkyl, amino, $C_{1-4}$alkyl-amino, $(C_{1-4}alkyl)_2$-amino, amino-$C_{1-4}$alkyl, $C_{1-4}$alkyl-amino-$C_{1-4}$alkyl, $(C_{1-4}alkyl)_2$-amino-$C_{1-4}$alkyl, amino-carbonyl, hydroxyl-$C_{1-4}$alkyl, $C_{1-4}$alkoxy, $C_{1-4}$alkoxy-carbonyl, $C_{2-4}$alkenyl, $C_{3-7}$cycloalkyl, or heterocyclyl-$C_{1-4}$alkyl,
  wherein heterocyclyl is a saturated or partially unsaturated monocyclic or bicyclic ring system having 1, 2, or 3 heteroatom ring members selected from N, O, and S, and
  wherein each instance of heterocyclyl is optionally substituted with 1, or 2 substituents each selected from $R_3$;
$R_3$ is halogen, hydroxyl, nitro, oxo, hydroxyl-imino, $C_{1-4}$alkyl, halo-$C_{1-4}$alkyl, amino, $C_{1-4}$alkyl-amino, $(C_{1-4}alkyl)_2$-amino, amino-$C_{1-4}$alkyl, $C_{1-4}$alkyl-amino-$C_{1-4}$alkyl, $(C_{1-4}alkyl)_2$-amino-$C_{1-4}$alkyl, amino-carbonyl, $C_{1-4}$alkyl-amino-carbonyl, $(C_{1-4}alkyl)_2$-amino-carbonyl, $C_{1-4}$alkyl-amino-carbonyl-$C_{1-4}$alkyl, $(C_{1-4}alkyl)_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}alkyl)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, phenyl, or phenyl-$C_{1-4}$alkoxy;
$R_4$ is independently selected from halogen, $C_{1-4}$alkyl, hydroxyl-$C_{1-4}$alkyl, amino, $C_{1-4}$alkyl-amino, $(C_{1-4}alkyl)_2$-amino or hydroxyl-$C_{1-4}$alkyl-amino; and
$R_5$ is hydrogen, $C_{1-4}$alkyl, or hydroxyl-$C_{1-4}$alkyl;
wherein a form of the compound is selected from the group consisting of a prodrug, salt, hydrate, solvate, clathrate, isotopologue, racemate, enantiomer, diastereomer, stereoisomer, polymorph and tautomer form thereof.

In a specific aspect of the foregoing aspect, the intron further comprises in 5' to 3' order: a 5' splice site, a branch point, and a 3' splice site upstream of the iREMS.

In another aspect, provided herein is a method for modifying RNA splicing in order to prevent or treat a disease or disorder in which a change in the level of expression of one, two, three or more RNA isoforms encoded by a gene is beneficial to the prevention or treatment of the disease, the method comprising administering a compound described herein to a subject in need thereof, wherein the one, two, three or more RNA isoforms are produced from a pre-mRNA transcript comprising three exons and two introns, wherein three exons and two introns are in the following order 5' to 3': a first exon, a first intron, a second exon, a second intron and a third exon, wherein the first intron comprises a RNA nucleotide sequence comprising in 5' to 3' order: a first 5' splice site, a first branch point and a first 3' splice site, wherein the second intron comprises a RNA nucleotide sequence comprising in 5' to 3' order: a second 5' splice site, an intronic recognition element for splicing modifier (iREMS), a second branch point, and a second 3' splice site, wherein the iREMS comprises an RNA sequence GAgurngn, wherein r is adenine or guanine and n is any nucleotide, and wherein Formula (I) is:

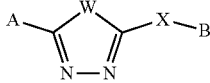

or a form thereof, wherein
W is CH=CH or S;
X is $CH_2$, $CH(C_{1-4}alkyl)$, $C(C_{1-4}alkyl)_2$, CH=CH, O, $NR_5$, or a bond;
A is aryl, heteroaryl, heterocyclyl, or $C_{9-10}$cycloalkyl,
  wherein aryl is selected from phenyl and naphthyl, each optionally substituted with 1, 2, 3, or 4 substituents each selected from $R_1$,
  wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from $R_1$,
  wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from $R_2$, and
  wherein $C_{9-10}$cycloalkyl is a saturated or partially unsaturated bicyclic ring system optionally substituted with 1, 2, 3, 4, or 5 substituents each selected from $R_2$;
B is heterocyclyl,
  wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from $R_4$;
$R_1$ is halogen, hydroxyl, cyano, $C_{1-4}$alkyl, halo-$C_{1-4}$alkyl, amino, $C_{1-4}$alkyl-amino, $(C_{1-4}alkyl)_2$-amino, amino-$C_{1-4}$alkyl, $C_{1-4}$alkyl-amino-$C_{1-4}$alkyl, $(C_{1-4}alkyl)_2$-amino-$C_{1-4}$alkyl, amino-carbonyl, $C_{1-4}$alkyl-amino-carbonyl, $(C_{1-4}alkyl)_2$-amino-carbonyl, $C_{1-4}$alkyl-amino-carbonyl-$C_{1-4}$alkyl, $(C_{1-4}alkyl)_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}alkyl)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, heterocyclyl-$C_{1-4}$alkoxy, phenyl, or phenyl-$C_{1-4}$alkoxy,
  wherein heteroaryl is a saturated monocyclic or bicyclic ring system having 1, 2, or 3 heteroatom ring members selected from N, O, and S,
  wherein heterocyclyl is a saturated or partially unsaturated monocyclic or bicyclic ring system having 1, 2, or 3 heteroatom ring members selected from N, O, and S, and
  wherein each instance of phenyl, heteroaryl or heterocyclyl is optionally substituted with 1, or 2 substituents each selected from $R_3$;
$R_2$ is halogen, hydroxyl, cyano, oxo, hydroxyl-imino, $C_{1-4}$alkyl, halo-$C_{1-4}$alkyl, amino, $C_{1-4}$alkyl-amino, $(C_{1-4}alkyl)_2$-amino, amino-$C_{1-4}$alkyl, $C_{1-4}$alkyl-amino-$C_{1-4}$alkyl, $(C_{1-4}alkyl)_2$-amino-$C_{1-4}$alkyl, amino-carbonyl, hydroxyl-$C_{1-4}$alkyl, $C_{1-4}$alkoxy, $C_{1-4}$alkoxy-carbonyl, $C_{2-4}$alkenyl, $C_{3-7}$cycloalkyl, or heterocyclyl-$C_{1-4}$alkyl,
  wherein heterocyclyl is a saturated or partially unsaturated monocyclic or bicyclic ring system having 1, 2, or 3 heteroatom ring members selected from N, O, and S, and wherein each instance of heterocyclyl is optionally substituted with 1, or 2 substituents each selected from $R_3$;
$R_3$ is halogen, hydroxyl, nitro, oxo, hydroxyl-imino, $C_{1-4}$alkyl, halo-$C_{1-4}$alkyl, amino, $C_{1-4}$alkyl-amino, $(C_{1-4}alkyl)_2$-amino, amino-$C_{1-4}$alkyl, $C_{1-4}$alkyl-amino-$C_{1-4}$alkyl, $(C_{1-4}alkyl)_2$-amino-$C_{1-4}$alkyl, amino-carbonyl, $C_{1-4}$alkyl-amino-carbonyl, $(C_{1-4}alkyl)_2$-amino-carbonyl, $C_{1-4}$alkyl-amino-carbonyl-$C_{1-4}$alkyl, $(C_{1-4}alkyl)_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}alkyl)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, phenyl, or phenyl-$C_{1-4}$alkoxy;
$R_4$ is independently selected from halogen, $C_{1-4}$alkyl, hydroxyl-$C_{1-4}$alkyl, amino, $C_{1-4}$alkyl-amino, $(C_{1-4}alkyl)_2$-amino or hydroxyl-$C_{1-4}$alkyl-amino; and
$R_5$ is hydrogen, $C_{1-4}$alkyl, or hydroxyl-$C_{1-4}$alkyl;
wherein a form of the compound is selected from the group consisting of a prodrug, salt, hydrate, solvate, clathrate, isotopologue, racemate, enantiomer, diastereomer, stereoisomer, polymorph and tautomer form thereof.

In some aspects, the iREMS is an endogenous iREMS. In other aspects, the iREMS is a non-endogenous iREMS.

In another aspect, provided herein is an artificial gene construct comprising an RNA sequence comprising exons and one or more introns, wherein at least one intron comprises an iREMS that is downstream of a branch point and a 3' splice site, and wherein the iREMS comprises the sequence GAgurngn, wherein r is adenine or guanine and n is any nucleotide.

In another aspect, provided herein is an artificial gene construct comprising an RNA sequence comprising two exons and an intron, wherein a first exon is upstream of the intron and a second exon is downstream of the intron, wherein the RNA nucleotide sequence of the intron comprises in 5' to 3' order: a first 5' splice site, a first branch point, a first 3' splice site, an iREMS, a second branch point and a second 3' splice site, wherein the iREMS comprises an RNA sequence GAgurngn, wherein r is adenine or guanine and n is any nucleotide.

In another aspect, provided herein is an artificial gene construct comprising an RNA sequence comprising two exons and an intron, wherein a first exon is upstream of the intron and a second exon is downstream of the intron, wherein the RNA nucleotide sequence of the intron comprises in 5' to 3' order: an iREMS, a branch point and a 3' splice site, wherein the iREMS comprises an RNA sequence GAgurngn, wherein r is adenine or guanine and n is any nucleotide.

In another aspect, provided herein is a cell comprising an artificial gene construct described herein.

In a specific aspect, the iREMS comprises an RNA sequence GAguragu, wherein r is adenine or guanine.

In another specific aspect, the iREMS comprises an RNA sequence NNGAgurngn (SEQ ID NO: 1), wherein r is adenine or guanine and n or N is any nucleotide. In a specific aspect, the RNA sequence NNGAgurngn (SEQ ID NO: 1) is selected from the group consisting of ANGAgurngn (SEQ ID NO: 4), CNGAgurngn (SEQ ID NO: 5), GNGAgurngn (SEQ ID NO: 6), UNGAgurngn (SEQ ID NO: 7), NAGAgurngn (SEQ ID NO: 8), NCGAgurngn (SEQ ID NO: 9), NGGAgurngn (SEQ ID NO: 10), NUGAgurngn (SEQ ID NO: 11), AAGAgurngn (SEQ ID NO: 12), ACGAgurngn (SEQ ID NO: 13), AGGAgurngn (SEQ ID NO: 14), AUGAgurngn (SEQ ID NO: 15), CAGAgurngn (SEQ ID NO: 16), CCGAgurngn (SEQ ID NO: 17), CGGAgurngn (SEQ ID NO: 18), CUGAgurngn (SEQ ID NO: 19), GAGAgurngn (SEQ ID NO: 20), GCGAgurngn (SEQ ID NO: 21), GGGAgurngn (SEQ ID NO: 22), GUGAgurngn (SEQ ID NO: 23), UAGAgurngn (SEQ ID NO: 24), UCGAgurngn (SEQ ID NO: 25), UGGAgurngn (SEQ ID NO: 52) and UUGAgurngn (SEQ ID NO: 53), wherein r is adenine or guanine and n or N is any nucleotide.

In another specific aspect, the iREMS comprises an RNA sequence NNGAguragu (SEQ ID NO: 2), wherein r is adenine or guanine and N is any nucleotide. In a specific aspect, the RNA sequence NNGAguragu (SEQ ID NO: 2) is selected from the group consisting of ANGAguragu (SEQ ID NO: 28), CNGAguragu (SEQ ID NO: 29), GNGAguragu (SEQ ID NO: 30), UNGAguragu (SEQ ID NO: 31), NAGAguragu (SEQ ID NO: 32), NCGAguragu (SEQ ID NO: 33), NGGAguragu (SEQ ID NO: 34), NUGAguragu (SEQ ID NO: 35), AAGAguragu (SEQ ID NO: 36), ACGAguragu (SEQ ID NO: 37), AGGAguragu (SEQ ID NO: 38), AUGAguragu (SEQ ID NO: 39), CAGAguragu (SEQ ID NO: 40), CCGAguragu (SEQ ID NO: 41), CGGAguragu (SEQ ID NO: 42), CUGAguragu (SEQ ID NO: 43), GAGAguragu (SEQ ID NO: 44), GCGAguragu (SEQ ID NO: 45), GGGAguragu (SEQ ID NO: 46), GUGAguragu (SEQ ID NO: 47), UAGAguragu (SEQ ID NO: 48), UCGAguragu (SEQ ID NO: 49), UGGAguragu (SEQ ID NO: 489) and UUGAguragu (SEQ ID NO: 508), wherein r is adenine or guanine, and N is any nucleotide.

In certain aspects, n is adenine or guanine.

In one aspect, provided herein is a method for modifying RNA splicing in order to produce a mature mRNA transcript having an iExon, the method comprising contacting a pre-mRNA transcript produced from a DNA sequence with a compound of Formula (I) or a form thereof, wherein the DNA sequence encodes two exons and an intron, wherein the nucleotide sequence encoding a first exon is upstream of the nucleotide sequence encoding the intron and the nucleotide sequence encoding a second exon is downstream of the nucleotide sequence encoding the intron, wherein the nucleotide sequence encoding the intron comprises in 5' to 3' order: a nucleotide sequence encoding a first 5' splice site, a nucleotide sequence encoding a first branch point, a nucleotide sequence encoding a first 3' splice site, a nucleotide sequence encoding an intronic recognition element for splicing modifier (iREMS), a nucleotide sequence encoding a second branch point, and a nucleotide sequence encoding a second 3' splice site, wherein the nucleotide sequence encoding the iREMS comprises a DNA sequence GAgtrngn, wherein r is adenine or guanine and n is any nucleotide, and wherein Formula (I) is:

or a form thereof, wherein
W is CH=CH or S;
X is $CH_2$, $CH(C_{1-4}alkyl)$, $C(C_{1-4}alkyl)_2$, CH=CH, O, $NR_5$, or a bond;
A is aryl, heteroaryl, heterocyclyl, or $C_{9-10}$cycloalkyl,
wherein aryl is selected from phenyl and naphthyl, each optionally substituted with 1, 2, 3, or 4 substituents each selected from $R_1$,
wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from $R_1$,
wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from $R_2$, and
wherein $C_{9-10}$cycloalkyl is a saturated or partially unsaturated bicyclic ring system optionally substituted with 1, 2, 3, 4, or 5 substituents each selected from $R_2$;
B is heterocyclyl,
wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from $R_4$;
$R_1$ is halogen, hydroxyl, cyano, $C_{1-4}$alkyl, halo-$C_{1-4}$alkyl, amino, $C_{1-4}$alkyl-amino, $(C_{1-4}alkyl)_2$-amino, amino-$C_{1-4}$alkyl, $C_{1-4}$alkyl-amino-$C_{1-4}$alkyl, $(C_{1-4}alkyl)_2$-amino-$C_{1-4}$alkyl, amino-carbonyl, $C_{1-4}$alkyl-amino-carbonyl, $(C_{1-4}alkyl)_2$-amino-carbonyl, $C_{1-4}$alkyl-amino-carbonyl-$C_{1-4}$alkyl, $(C_{1-4}alkyl)_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}alkyl)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, heterocyclyl-$C_{1-4}$alkoxy, phenyl, or phenyl-$C_{1-4}$alkoxy,
wherein heteroaryl is a saturated monocyclic or bicyclic ring system having 1, 2, or 3 heteroatom ring members selected from N, O, and S,
wherein heterocyclyl is a saturated or partially unsaturated monocyclic or bicyclic ring system having 1, 2, or 3 heteroatom ring members selected from N, O, and S, and wherein each instance of phenyl, heteroaryl or heterocyclyl is optionally substituted with 1, or 2 substituents each selected from $R_3$;

$R_2$ is halogen, hydroxyl, cyano, oxo, hydroxyl-imino, $C_{1-4}$alkyl, halo-$C_{1-4}$alkyl, amino, $C_{1-4}$alkyl-amino, ($C_{1-4}$alkyl)$_2$-amino, amino-$C_{1-4}$alkyl, $C_{1-4}$alkyl-amino-$C_{1-4}$alkyl, ($C_{1-4}$alkyl)$_2$-amino-$C_{1-4}$alkyl, amino-carbonyl, hydroxyl-$C_{1-4}$alkyl, $C_{1-4}$alkoxy, $C_{1-4}$alkoxy-carbonyl, $C_{2-4}$alkenyl, $C_{3-7}$cycloalkyl, or heterocyclyl-$C_{1-4}$alkyl, wherein heterocyclyl is a saturated or partially unsaturated monocyclic or bicyclic ring system having 1, 2, or 3 heteroatom ring members selected from N, O, and S, and wherein each instance of heterocyclyl is optionally substituted with 1, or 2 substituents each selected from $R_3$;

$R_3$ is halogen, hydroxyl, nitro, oxo, hydroxyl-imino, $C_{1-4}$alkyl, halo-$C_{1-4}$alkyl, amino, $C_{1-4}$alkyl-amino, ($C_{1-4}$alkyl)$_2$-amino, amino-$C_{1-4}$alkyl, $C_{1-4}$alkyl-amino-$C_{1-4}$alkyl, ($C_{1-4}$alkyl)$_2$-amino-$C_{1-4}$alkyl, amino-carbonyl, $C_{1-4}$alkyl-amino-carbonyl, ($C_{1-4}$alkyl)$_2$-amino-carbonyl, $C_{1-4}$alkyl-amino-carbonyl-$C_{1-4}$alkyl, ($C_{1-4}$alkyl)$_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, ($C_{1-4}$alkyl)$_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, phenyl, or phenyl-$C_{1-4}$alkoxy;

$R_4$ is independently selected from halogen, $C_{1-4}$alkyl, hydroxyl-$C_{1-4}$alkyl, amino, $C_{1-4}$alkyl-amino, ($C_{1-4}$alkyl)$_2$-amino or hydroxyl-$C_{1-4}$alkyl-amino; and $R_5$ is hydrogen, $C_{1-4}$alkyl, or hydroxyl-$C_{1-4}$alkyl;

wherein a form of the compound is selected from the group consisting of a prodrug, salt, hydrate, solvate, clathrate, isotopologue, racemate, enantiomer, diastereomer, stereoisomer, polymorph and tautomer form thereof.

In another aspect, provided herein is a method for modifying RNA splicing in order to modulate the amount of a mature mRNA transcript produced by a pre-mRNA transcript that is produced by a DNA sequence, the method comprising contacting the pre-mRNA transcript produced from the DNA sequence with a compound of Formula (I) or a form thereof, wherein the DNA sequence encodes two exons and an intron, wherein the nucleotide sequence encoding a first exon is upstream of the nucleotide sequence encoding the intron and the nucleotide sequence encoding a second exon is downstream of the nucleotide sequence encoding the intron, wherein the nucleotide sequence encoding the intron comprises a DNA nucleotide sequence comprising in 5' to 3' order: a nucleotide sequence encoding an intronic recognition element for splicing modifier (iREMS), a nucleotide sequence encoding a branch point, and a nucleotide sequence encoding a 3' splice site, wherein the nucleotide sequence encoding the iREMS comprises a DNA sequence GAgtrngn, wherein r is adenine or guanine and n is any nucleotide, and wherein Formula (I) is:

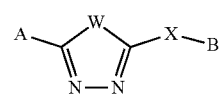

or a form thereof, wherein

W is CH=CH or S;

X is $CH_2$, $CH(C_{1-4}alkyl)$, $C(C_{1-4}alkyl)_2$, CH=CH, O, $NR_5$, or a bond;

A is aryl, heteroaryl, heterocyclyl, or $C_{9-10}$cycloalkyl, wherein aryl is selected from phenyl and naphthyl, each optionally substituted with 1, 2, 3, or 4 substituents each selected from $R_1$, wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from $R_1$, wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from $R_2$, and wherein $C_{9-10}$cycloalkyl is a saturated or partially unsaturated bicyclic ring system optionally substituted with 1, 2, 3, 4, or 5 substituents each selected from $R_2$;

B is heterocyclyl, wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from $R_4$;

$R_1$ is halogen, hydroxyl, cyano, $C_{1-4}$alkyl, halo-$C_{1-4}$alkyl, amino, $C_{1-4}$alkyl-amino, ($C_{1-4}$alkyl)$_2$-amino, amino-$C_{1-4}$alkyl, $C_{1-4}$alkyl-amino-$C_{1-4}$alkyl, ($C_{1-4}$alkyl)$_2$-amino-$C_{1-4}$alkyl, amino-carbonyl, $C_{1-4}$alkyl-amino-carbonyl, ($C_{1-4}$alkyl)$_2$-amino-carbonyl, $C_{1-4}$alkyl-amino-carbonyl-$C_{1-4}$alkyl, ($C_{1-4}$alkyl)$_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, ($C_{1-4}$alkyl)$_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, heterocyclyl-$C_{1-4}$alkoxy, phenyl, or phenyl-$C_{1-4}$alkoxy, wherein heteroaryl is a saturated monocyclic or bicyclic ring system having 1, 2, or 3 heteroatom ring members selected from N, O, and S, wherein heterocyclyl is a saturated or partially unsaturated monocyclic or bicyclic ring system having 1, 2, or 3 heteroatom ring members selected from N, O, and S, and wherein each instance of phenyl, heteroaryl or heterocyclyl is optionally substituted with 1, or 2 substituents each selected from $R_3$;

$R_2$ is halogen, hydroxyl, cyano, oxo, hydroxyl-imino, $C_{1-4}$alkyl, halo-$C_{1-4}$alkyl, amino, $C_{1-4}$alkyl-amino, ($C_{1-4}$ 4alkyl)2-amino, amino-$C_{1-4}$alkyl, $C_{1-4}$alkyl-amino-$C_{1-4}$alkyl, ($C_{1-4}$alkyl)2-amino-$C_{1-4}$alkyl, amino-carbonyl, hydroxyl-$C_{1-4}$alkyl, $C_{1-4}$alkoxy, $C_{1-4}$alkoxy-carbonyl, $C_{2-4}$alkenyl, $C_{3-7}$cycloalkyl, or heterocyclyl-$C_{1-4}$alkyl,
wherein heterocyclyl is a saturated or partially unsaturated monocyclic or bicyclic ring system having 1, 2, or 3 heteroatom ring members selected from N, O, and S, and wherein each instance of heterocyclyl is optionally substituted with 1, or 2 substituents each selected from $R_3$;
$R_3$ is halogen, hydroxyl, nitro, oxo, hydroxyl-imino, $C_{1-4}$alkyl, halo-$C_{1-4}$alkyl, amino, $C_{1-4}$alkyl-amino, ($C_{1-4}$alkyl)2-amino, amino-$C_{1-4}$alkyl, $C_{1-4}$alkyl-amino-$C_{1-4}$alkyl, ($C_{1-4}$alkyl)2-amino-$C_{1-4}$alkyl, amino-carbonyl, $C_{1-4}$alkyl-amino-carbonyl, ($C_{1-4}$alkyl)2-amino-carbonyl, $C_{1-4}$alkyl-amino-carbonyl-$C_{1-4}$alkyl, ($C_{1-4}$alkyl)2-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, ($C_{1-4}$alkyl)2-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, phenyl, or phenyl-$C_{1-4}$alkoxy;
$R_4$ is independently selected from halogen, $C_{1-4}$alkyl, hydroxyl-$C_{1-4}$alkyl, amino, $C_{1-4}$alkyl-amino, ($C_{1-4}$alkyl)2-amino or hydroxyl-$C_{1-4}$alkyl-amino; and
$R_5$ is hydrogen, $C_{1-4}$alkyl, or hydroxyl-$C_{1-4}$alkyl;
wherein a form of the compound is selected from the group consisting of a prodrug, salt, hydrate, solvate, clathrate, isotopologue, racemate, enantiomer, diastereomer, stereoisomer, polymorph and tautomer form thereof.

In a specific aspect of the foregoing aspect, the nucleotide sequence encoding the intron further comprises in 5' to 3' order: a nucleotide sequence encoding a 5' splice site, a nucleotide sequence encoding a branch point, and a nucleotide sequence encoding a 3' splice site upstream of the nucleotide sequence encoding the iREMS.

In another aspect, provided herein is a method for modifying RNA splicing in order to modulate the amount of a mature mRNA transcript produced by a pre-mRNA transcript that is produced by a DNA sequence, the method comprising contacting the pre-mRNA transcript produced from the DNA sequence with a compound of Formula (I) or a form thereof, wherein the DNA sequence encodes three exons and two introns, wherein the nucleotide sequences encoding the three exons and the two introns respectively are in the following order 5' to 3': a nucleotide sequence encoding a first exon, a nucleotide sequence encoding a first intron, a nucleotide sequence encoding a second exon, a nucleotide sequence encoding a second intron and a nucleotide sequence encoding a third exon, wherein the nucleotide sequence encoding the first intron comprises a DNA nucleotide sequence comprising in 5' to 3' order: a nucleotide sequence encoding a first 5' splice site, a nucleotide sequence encoding a first branch point and a nucleotide sequence encoding a first 3' splice site, wherein the nucleotide sequence encoding the second intron comprises a DNA nucleotide sequence comprising in 5' to 3' order: a nucleotide sequence encoding a second 5' splice site, a nucleotide sequence encoding an intronic recognition element for splicing modifier (iREMS), a nucleotide sequence encoding a second branch point, and a nucleotide sequence encoding a second 3' splice site, wherein the nucleotide sequence encoding the iREMS comprises a DNA sequence GAgtrngn, wherein r is adenine or guanine and n is any nucleotide, and wherein Formula (I) is:

or a form thereof, wherein
W is CH=CH or S:
X is $CH_2$, $CH(C_{1-4}alkyl)$, $C(C_{1-4}alkyl)_2$, CH=CH, O, $NR_5$, or a bond;
A is aryl, heteroaryl, heterocyclyl, or $C_{9-10}$cycloalkyl,
wherein aryl is selected from phenyl and naphthyl, each optionally substituted with 1, 2, 3, or 4 substituents each selected from $R_1$,
wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from $R_1$,
wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from $R_2$, and
wherein $C_{9-10}$cycloalkyl is a saturated or partially unsaturated bicyclic ring system optionally substituted with 1, 2, 3, 4, or 5 substituents each selected from $R_2$;
B is heterocyclyl,
wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from $R_4$;
$R_1$ is halogen, hydroxyl, cyano, $C_{1-4}$alkyl, halo-$C_{1-4}$alkyl, amino, $C_{1-4}$alkyl-amino, ($C_{1-4}$alkyl)2-amino, amino-$C_{1-4}$alkyl, $C_{1-4}$alkyl-amino-$C_{1-4}$alkyl, ($C_{1-4}$alkyl)2-amino-$C_{1-4}$alkyl, amino-carbonyl, $C_{1-4}$alkyl-amino-carbonyl, ($C_{1-4}$alkyl)2-amino-carbonyl, $C_{1-4}$alkyl-amino-carbonyl-$C_{1-4}$alkyl, ($C_{1-4}$alkyl)2-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, ($C_{1-4}$alkyl)2-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, heterocyclyl-$C_{1-4}$alkoxy, phenyl, or phenyl-$C_{1-4}$alkoxy,
wherein heteroaryl is a saturated monocyclic or bicyclic ring system having 1, 2, or 3 heteroatom ring members selected from N, O, and S, wherein heterocyclyl is a saturated or partially unsaturated monocyclic or bicyclic ring system having 1, 2, or 3 heteroatom ring members selected from N, O, and S, and wherein each instance of phenyl, heteroaryl or heterocyclyl is optionally substituted with 1, or 2 substituents each selected from $R_3$;

$R_2$ is halogen, hydroxyl, cyano, oxo, hydroxyl-imino, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, hydroxyl-$C_{1-4}$alkyl, $C_{1-4}$alkoxy, $C_{1-4}$alkoxy-carbonyl, $C_{2-4}$alkenyl, $C_{3-7}$cycloalkyl, or heterocyclyl-$C_{1-4}$alkyl, wherein heterocyclyl is a saturated or partially unsaturated monocyclic or bicyclic ring system having 1, 2, or 3 heteroatom ring members selected from N, O, and S, and wherein each instance of heterocyclyl is optionally substituted with 1, or 2 substituents each selected from $R_3$;

$R_3$ is halogen, hydroxyl, nitro, oxo, hydroxyl-imino, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, $C_{1-4}$alkyl-amino-carbonyl, $(C_{1-4}$alkyl$)_2$-amino-carbonyl, $C_{1-4}$alkyl-amino-carbonyl-$C_{1-4}$alkyl, $(C_{1-4}$alkyl$)_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}$alkyl$)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, phenyl, or phenyl-$C_{1-4}$alkoxy;

$R_4$ is independently selected from halogen, $C_{1-4}$alkyl, hydroxyl-$C_{1-4}$alkyl, amino, $C_{1-4}$alkyl-amino, $(C_{1-4}$alkyl$)_2$-amino or hydroxyl-$C_{1-4}$alkyl-amino; and $R_5$ is hydrogen, $C_{1-4}$alkyl, or hydroxyl-$C_{1-4}$alkyl;

wherein a form of the compound is selected from the group consisting of a prodrug, salt, hydrate, solvate, clathrate, isotopologue, racemate, enantiomer, diastereomer, stereoisomer, polymorph and tautomer form thereof.

In some aspects, the nucleotide sequence encoding the iREMS is a nucleotide sequence encoding an endogenous iREMS. In other aspects, the nucleotide sequence encoding the iREMS is a nucleotide sequence encoding a non-endogenous iREMS.

In another aspect, provided herein is a method for modifying RNA splicing in order to produce a mature mRNA transcript having an iExon, the method comprising contacting a pre-mRNA transcript produced from a DNA sequence with a compound of Formula (I) or a form thereof, wherein the DNA sequence encodes two exons and an intron, wherein the nucleotide sequence encoding a first exon is upstream of the nucleotide sequence encoding the intron and the nucleotide sequence encoding a second exon is downstream of the nucleotide sequence encoding the intron, wherein the nucleotide sequence encoding the intron comprises in 5' to 3' order: a nucleotide sequence encoding a first 5' splice site, a nucleotide sequence encoding a first branch point, a nucleotide sequence encoding a first 3' splice site, a nucleotide sequence encoding an endogenous intronic recognition element for splicing modifier (iREMS), a nucleotide sequence encoding a second branch point, and a nucleotide sequence encoding a second 3' splice site, wherein the nucleotide sequence encoding the iREMS comprises a DNA sequence GAgtrngn, wherein r is adenine or guanine and n is any nucleotide, wherein the DNA sequence is the DNA sequence of a gene that is selected from the genes listed in a table herein, and wherein Formula (I) is:

or a form thereof, wherein

W is CH=CH or S;

X is $CH_2$, $CH(C_{1-4}$alkyl), $C(C_{1-4}$alkyl$)_2$, CH=CH, O, $NR_5$, or a bond;

A is aryl, heteroaryl, heterocyclyl, or $C_{9-10}$cycloalkyl, wherein aryl is selected from phenyl and naphthyl, each optionally substituted with 1, 2, 3, or 4 substituents each selected from $R_1$, wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from $R_1$, wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from $R_2$, and wherein $C_{9-10}$cycloalkyl is a saturated or partially unsaturated bicyclic ring system optionally substituted with 1, 2, 3, 4, or 5 substituents each selected from $R_2$;

B is heterocyclyl, wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from $R_4$;

$R_1$ is halogen, hydroxyl, cyano, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, $C_{1-4}$alkyl-amino-carbonyl, $(C_{1-4}$alkyl$)_2$-amino-carbonyl, $C_{1-4}$alkyl-amino-carbonyl-$C_{1-4}$alkyl, $(C_{1-4}$alkyl$)_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}$alkyl$)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, heterocyclyl-$C_{1-4}$alkoxy, phenyl, or phenyl-$C_{1-4}$alkoxy, wherein heteroaryl is a saturated monocyclic or bicyclic ring system having 1, 2, or 3 heteroatom ring members selected from N, O, and S, wherein heterocyclyl is a saturated or partially unsaturated monocyclic or bicyclic ring system having 1, 2, or 3 heteroatom ring members selected from N, O, and S, and wherein each instance of phenyl, heteroaryl or heterocyclyl is optionally substituted with 1, or 2 substituents each selected from $R_3$;

$R_2$ is halogen, hydroxyl, cyano, oxo, hydroxyl-imino, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, hydroxyl-$C_{1-4}$alkyl, $C_{1-4}$alkoxy, $C_{1-4}$alkoxy-carbonyl, $C_{2-4}$alkenyl, $C_{3-7}$cycloalkyl, or heterocyclyl-$C_{1-4}$alkyl, wherein heterocyclyl is a saturated or partially unsaturated monocyclic or bicyclic ring system having 1, 2, or 3 heteroatom ring members selected from N, O, and S, and wherein each instance of heterocyclyl is optionally substituted with 1, or 2 substituents each selected from $R_3$;

$R_3$ is halogen, hydroxyl, nitro, oxo, hydroxyl-imino, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, $C_{1-4}$alkyl-amino-carbonyl, $(C_{1-4}$alkyl$)_2$-amino-carbonyl, $C_{1-4}$alkyl-amino-carbonyl-$C_{1-4}$alkyl, $(C_{1-4}$alkyl$)_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}$alkyl$)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, phenyl, or phenyl-$C_{1-4}$alkoxy;

$R_4$ is independently selected from halogen, $C_{1-4}$alkyl, hydroxyl-$C_{1-4}$alkyl, amino, $C_{1-4}$alkyl-amino, $(C_{1-4}$alkyl$)_2$-amino or hydroxyl-$C_{1-4}$alkyl-amino; and $R_5$ is hydrogen, $C_{1-4}$alkyl, or hydroxyl-$C_{1-4}$alkyl;

wherein a form of the compound is selected from the group consisting of a prodrug, salt, hydrate, solvate, clathrate, isotopologue, racemate, enantiomer, diastereomer, stereoisomer, polymorph and tautomer form thereof.

In another aspect, provided herein is a method for modifying RNA splicing in order to modulate the amount of a mature mRNA transcript produced by a pre-mRNA transcript that is produced by a DNA sequence, the method comprising contacting the pre-mRNA transcript produced from the DNA sequence with a compound of Formula (I) or a form thereof, wherein the DNA sequence encodes two exons and an intron, wherein the nucleotide sequence encoding a first exon is upstream of the nucleotide sequence encoding the intron and the nucleotide sequence encoding a second exon is downstream of the nucleotide sequence encoding the intron, wherein the nucleotide sequence encoding the intron comprises a DNA nucleotide sequence comprising in 5' to 3' order: a nucleotide sequence encoding an endogenous or non-endogenous intronic recognition element for splicing modifier (iREMS), a nucleotide sequence encoding a branch point, and a nucleotide sequence encoding a 3' splice site, wherein the nucleotide sequence encoding the iREMS comprises a DNA sequence GAgtrngn, wherein r is adenine or guanine and n is any nucleotide, wherein the DNA sequence is the DNA sequence of a gene that is selected from the genes listed in a table herein, and wherein Formula (I) is:

or a form thereof, wherein

W is CH=CH or S;

X is $CH_2$, $CH(C_{1-4}$alkyl), $C(C_{1-4}$alkyl$)_2$, CH=CH, O, $NR_5$, or a bond;

A is aryl, heteroaryl, heterocyclyl, or $C_{9-10}$cycloalkyl, wherein aryl is selected from phenyl and naphthyl, each optionally substituted with 1, 2, 3, or 4 substituents each selected from $R_1$, wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from $R_1$, wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from $R_2$, and wherein $C_{9-10}$cycloalkyl is a saturated or partially unsaturated bicyclic ring system optionally substituted with 1, 2, 3, 4, or 5 substituents each selected from $R_2$;

B is heterocyclyl, wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from $R_4$;

$R_1$ is halogen, hydroxyl, cyano, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, $C_{1-4}$alkyl-amino-carbonyl, $(C_{1-4}$alkyl$)_2$-amino-carbonyl, $C_{1-4}$alkyl-amino-carbonyl-$C_{1-4}$alkyl, $(C_{1-4}$alkyl$)_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}$alkyl$)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, C4alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, heterocyclyl-$C_{1-4}$alkoxy, phenyl, or phenyl-$C_{1-4}$alkoxy, wherein heteroaryl is a saturated monocyclic or bicyclic ring system having 1, 2, or 3 heteroatom ring members selected from N, O, and S, wherein heterocyclyl is a saturated or partially unsaturated monocyclic or bicyclic ring system having 1, 2, or 3 heteroatom ring members selected from N, O, and S, and wherein each instance of phenyl, heteroaryl or heterocyclyl is optionally substituted with 1, or 2 substituents each selected from $R_3$;

$R_2$ is halogen, hydroxyl, cyano, oxo, hydroxyl-imino, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, hydroxyl-$C_{1-4}$alkyl, $C_{1-4}$alkoxy, $C_{1-4}$alkoxy-carbonyl, $C_{2-4}$alkenyl, $C_{3-7}$cycloalkyl, or heterocyclyl-$C_{1-4}$alkyl, wherein heterocyclyl is a saturated or partially unsaturated monocyclic or bicyclic ring system having 1, 2, or 3 heteroatom ring members selected from N, O, and S, and wherein each instance of heterocyclyl is optionally substituted with 1, or 2 substituents each selected from $R_3$;

$R_3$ is halogen, hydroxyl, nitro, oxo, hydroxyl-imino, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, $C_{1-4}$alkyl-amino-carbonyl, $(C_{1-4}$alkyl$)_2$-amino-carbonyl, $C_{1-4}$alkyl-amino-carbonyl-$C_{1-4}$alkyl, $(C_{1-4}$alkyl$)_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}$alkyl$)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, phenyl, or phenyl-$C_{1-4}$alkoxy;

$R_4$ is independently selected from halogen, $C_{1-4}$alkyl, hydroxyl-$C_{1-4}$alkyl, amino, $C_{1-4}$alkyl-amino, $(C_{1-4}$alkyl$)_2$-amino or hydroxyl-$C_{1-4}$alkyl-amino; and $R_5$ is hydrogen, $C_{1-4}$alkyl, or hydroxyl-$C_{1-4}$alkyl;

wherein a form of the compound is selected from the group consisting of a prodrug, salt, hydrate, solvate, clathrate, isotopologue, racemate, enantiomer, diastereomer, stereoisomer, polymorph and tautomer form thereof.

In a specific aspect of the foregoing aspect, the nucleotide sequence encoding the intron further comprises in 5' to 3' order: a nucleotide sequence encoding a 5' splice site, a nucleotide sequence encoding a branch point, and a nucleotide sequence encoding a 3' splice site upstream of the nucleotide sequence encoding the iREMS.

In another aspect, provided herein is a method for modifying RNA splicing in order to modulate the amount of a mature mRNA transcript produced by a pre-mRNA transcript that is produced by a DNA sequence, the method comprising contacting the pre-mRNA transcript produced from the DNA sequence with a compound of Formula (I) or a form thereof, wherein the DNA sequence encodes three exons and two introns, wherein the nucleotide sequences encoding the three exons and the two introns respectively are in the following order 5' to 3': a nucleotide sequence encoding a first exon, a nucleotide sequence encoding a first intron, a nucleotide sequence encoding a second exon, a nucleotide sequence encoding a second intron and a nucleotide sequence encoding a third exon, wherein the nucleotide sequence encoding the first intron comprises a DNA nucleotide sequence comprising in 5' to 3' order: a nucleotide sequence encoding a first 5' splice site, a nucleotide sequence encoding a first branch point and a nucleotide sequence encoding a first 3' splice site, wherein the nucleotide sequence encoding the second intron comprises a DNA nucleotide sequence comprising in 5' to 3' order: a nucleotide sequence encoding a second 5' splice site, a nucleotide sequence encoding an endogenous or non-endogenous intronic recognition element for splicing modifier (iREMS), a nucleotide sequence encoding a second branch point, and a nucleotide sequence encoding a second 3' splice site, wherein the nucleotide sequence encoding the iREMS comprises a DNA sequence GAgtrngn, wherein r is adenine or guanine and n is any nucleotide, wherein the DNA sequence is the DNA sequence of a gene that is selected from the genes listed in a table herein, and wherein Formula (I) is:

or a form thereof, wherein

W is CH=CH or S;

X is $CH_2$, $CH(C_{1-4}$alkyl$)$, $C(C_{1-4}$alkyl$)_2$, CH=CH, O, $NR_5$, or a bond;

A is aryl, heteroaryl, heterocyclyl, or $C_{9-10}$cycloalkyl,
wherein aryl is selected from phenyl and naphthyl, each optionally substituted with 1, 2, 3, or 4 substituents each selected from $R_1$,
wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from $R_1$,
wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from $R_2$, and
wherein $C_{9-10}$cycloalkyl is a saturated or partially unsaturated bicyclic ring system optionally substituted with 1, 2, 3, 4, or 5 substituents each selected from $R_2$;

B is heterocyclyl,
wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from $R_4$;

$R_1$ is halogen, hydroxyl, cyano, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, $C_{1-4}$alkyl-amino-carbonyl, $(C_{1-4}$alkyl$)_2$-amino-carbonyl, $C_{1-4}$alkyl-amino-carbonyl-$C_{1-4}$alkyl, $(C_{1-4}$alkyl$)_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}$alkyl$)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-C$_{1-4}$alkoxy, C$_{3-7}$cycloalkenyl, heteroaryl, heteroaryl-C$_{1-4}$alkyl, heteroaryl-C$_{1-4}$alkyl-amino, heteroaryl-C$_{1-4}$alkyl-amino-carbonyl, heteroaryl-C$_{1-4}$alkyl-carbonyl-amino, heteroaryl-C$_{1-4}$alkyl-amino-carbonyl-C$_{1-4}$alkyl, heteroaryl-C$_{1-4}$alkyl-carbonyl-amino-C$_{1-4}$alkyl, heterocyclyl, heterocyclyl-C$_{1-4}$alkyl, heterocyclyl-C$_{1-4}$alkoxy, phenyl, or phenyl-C$_{1-4}$alkoxy, wherein heteroaryl is a saturated monocyclic or bicyclic ring system having 1, 2, or 3 heteroatom ring members selected from N, O, and S, wherein heterocyclyl is a saturated or partially unsaturated monocyclic or bicyclic ring system having 1, 2, or 3 heteroatom ring members selected from N, O, and S, and wherein each instance of phenyl, heteroaryl or heterocyclyl is optionally substituted with 1, or 2 substituents each selected from R$_3$;

R$_2$ is halogen, hydroxyl, cyano, oxo, hydroxyl-imino, C$_{1-4}$alkyl, halo-C$_{1-4}$alkyl, amino, C$_{1-4}$alkyl-amino, (C$_{1-4}$alkyl)$_2$-amino, amino-C$_{1-4}$alkyl, C$_{1-4}$alkyl-amino-C$_{1-4}$alkyl, (C$_{1-4}$alkyl)$_2$-amino-C$_{1-4}$alkyl, amino-carbonyl, hydroxyl-C$_{1-4}$alkyl, C$_{1-4}$alkoxy, C$_{1-4}$alkoxy-carbonyl, C$_{2-4}$alkenyl, C$_{3-7}$cycloalkyl, or heterocyclyl-C$_{1-4}$alkyl, wherein heterocyclyl is a saturated or partially unsaturated monocyclic or bicyclic ring system having 1, 2, or 3 heteroatom ring members selected from N, O, and S, and wherein each instance of heterocyclyl is optionally substituted with 1, or 2 substituents each selected from R$_3$;

R$_3$ is halogen, hydroxyl, nitro, oxo, hydroxyl-imino, C$_{1-4}$alkyl, halo-C$_{1-4}$alkyl, amino, C$_{1-4}$alkyl-amino, (C$_{1-4}$alkyl)$_2$-amino, amino-C$_{1-4}$alkyl, C$_{1-4}$alkyl-amino-C$_{1-4}$alkyl, (C$_{1-4}$alkyl)$_2$-amino-C$_{1-4}$alkyl, amino-carbonyl, C$_{1-4}$alkyl-amino-carbonyl, (C$_{1-4}$alkyl)$_2$-amino-carbonyl, C$_{1-4}$alkyl-amino-carbonyl-C$_{1-4}$alkyl, (C$_{1-4}$alkyl)$_2$-amino-carbonyl-C$_{1-4}$alkyl, C$_{1-4}$alkyl-carbonyl-amino, C$_{1-4}$alkyl-carbonyl-amino-C$_{1-4}$alkyl, hydroxyl-C$_{1-4}$alkyl, C$_{1-4}$alkyl-carbonyl, C$_{1-4}$alkoxy, halo-C$_{1-4}$alkoxy, amino-C$_{1-4}$alkoxy, hydroxyl-C$_{1-4}$alkoxy, C$_{1-4}$alkyl-C$_{1-4}$alkoxy, C$_{1-4}$alkyl-amino-C$_{1-4}$alkoxy, (C$_{1-4}$alkyl)$_2$-amino-C$_{1-4}$alkoxy, C$_{1-4}$alkyl-carbonyl-amino-C$_{1-4}$alkoxy, C$_{1-4}$alkoxy-C$_{1-4}$alkoxy, C$_{1-4}$alkoxy-carbonyl, C$_{1-4}$alkoxy-carbonyl-amino, C$_{1-4}$alkoxy-carbonyl-amino-C$_{1-4}$alkoxy, C$_{2-4}$alkenyl, C$_{2-4}$alkenyl-amino-carbonyl, C$_{3-7}$cycloalkyl, C$_{3-7}$cycloalkyl-C$_{1-4}$alkoxy, C$_{3-7}$cycloalkenyl, heteroaryl, heteroaryl-C$_{1-4}$alkyl, heteroaryl-C$_{1-4}$alkyl-amino, heteroaryl-C$_{1-4}$alkyl-amino-carbonyl, heteroaryl-C$_{1-4}$alkyl-carbonyl-amino, heteroaryl-C$_{1-4}$alkyl-amino-carbonyl-C$_{1-4}$alkyl, heteroaryl-C$_{1-4}$alkyl-carbonyl-amino-C$_{1-4}$alkyl, heterocyclyl, heterocyclyl-C$_{1-4}$alkyl, phenyl, or phenyl-C$_{1-4}$alkoxy;

R$_4$ is independently selected from halogen, C$_{1-4}$alkyl, hydroxyl-C$_{1-4}$alkyl, amino, C$_{1-4}$alkyl-amino, (C$_{1-4}$alkyl)$_2$-amino or hydroxyl-C$_{1-4}$alkyl-amino; and R$_5$ is hydrogen, C$_{1-4}$alkyl, or hydroxyl-C$_{1-4}$alkyl;

wherein a form of the compound is selected from the group consisting of a prodrug, salt, hydrate, solvate, clathrate, isotopologue, racemate, enantiomer, diastereomer, stereoisomer, polymorph and tautomer form thereof.

In another aspect, provided herein is a method for modifying RNA splicing in order to produce a mature mRNA transcript having an iExon, the method comprising contacting a pre-mRNA transcript produced from a DNA sequence with a compound of Formula (I) or a form thereof, wherein the DNA sequence encodes two exons and an intron, wherein the nucleotide sequence encoding a first exon is upstream of the nucleotide sequence encoding the intron and the nucleotide sequence encoding a second exon is downstream of the nucleotide sequence encoding the intron, wherein the nucleotide sequence encoding the intron comprises in 5' to 3' order: a nucleotide sequence encoding a first 5' splice site, a nucleotide sequence encoding a first branch point, a nucleotide sequence encoding a first 3' splice site, a nucleotide sequence encoding a non-endogenous intronic recognition element for splicing modifier (iREMS), a nucleotide sequence encoding a second branch point, and a nucleotide sequence encoding a second 3' splice site, wherein the nucleotide sequence encoding the iREMS comprises a DNA sequence GAgtrngn, wherein r is adenine or guanine and n is any nucleotide, and wherein Formula (I) is:

(I)

or a form thereof, wherein

W is CH=CH or S;

X is CH$_2$, CH(C$_{1-4}$alkyl), C(C$_{1-4}$alkyl)$_2$, CH=CH, O, NR$_5$, or a bond;

A is aryl, heteroaryl, heterocyclyl, or C$_{9-10}$cycloalkyl, wherein aryl is selected from phenyl and naphthyl, each optionally substituted with 1, 2, 3, or 4 substituents each selected from R$_1$, wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from R$_1$, wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from R$_2$, and wherein C$_{9-10}$cycloalkyl is a saturated or partially unsaturated bicyclic ring system optionally substituted with 1, 2, 3, 4, or 5 substituents each selected from R$_2$;

B is heterocyclyl, wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from R$_4$;

R$_1$ is halogen, hydroxyl, cyano, C$_{1-4}$alkyl, halo-C$_{1-4}$alkyl, amino, C$_{1-4}$alkyl-amino, (C$_{1-4}$alkyl)$_2$-amino, amino-C$_{1-4}$alkyl, C$_{1-4}$alkyl-amino-C$_{1-4}$alkyl, (C$_{1-4}$alkyl)$_2$-amino-C$_{1-4}$alkyl, amino-carbonyl, C$_{1-4}$alkyl-amino-carbonyl, (C$_{1-4}$alkyl)$_2$-amino-carbonyl, C$_{1-4}$alkyl-amino-carbonyl-C$_{1-4}$alkyl, (C$_{1-4}$alkyl)$_2$-amino-carbonyl-C$_{1-4}$alkyl, C$_{1-4}$alkyl-carbonyl-amino, C$_{1-4}$alkyl-carbonyl-amino-C$_{1-4}$alkyl, hydroxyl-C$_{1-4}$alkyl, C$_{1-4}$alkyl-carbonyl, C$_{1-4}$alkoxy, halo-C$_{1-4}$alkoxy, amino-C$_{1-4}$alkoxy, hydroxyl-C$_{1-4}$alkoxy, C$_{1-4}$alkyl-C$_{1-4}$alkoxy, C$_{1-4}$alkyl-amino-C4alkoxy, (C$_{1-4}$alkyl)$_2$-amino-C$_{1-4}$alkoxy, C$_{1-4}$alkyl-carbonyl-amino-C$_{1-4}$alkoxy, C$_{1-4}$alkoxy-C$_{1-4}$alkoxy, C$_{1-4}$alkoxy-carbonyl, C$_{1-4}$alkoxy-carbonyl-amino, C$_{1-4}$alkoxy-carbonyl-amino-C$_{1-4}$alkoxy, C$_{2-4}$alkenyl, C$_{2-4}$alkenyl-amino-carbonyl, C$_{3-7}$cycloalkyl, C$_{3-7}$cycloalkyl-C$_{1-4}$alkoxy, C$_{3-7}$cycloalkenyl, heteroaryl, heteroaryl-C$_{1-4}$alkyl, heteroaryl-C$_{1-4}$alkyl-amino, heteroaryl-C$_{1-4}$alkyl-amino-carbonyl, heteroaryl-C$_{1-4}$alkyl-carbonyl-amino, heteroaryl-C$_{1-4}$alkyl-amino-carbonyl-C$_{1-4}$alkyl, heteroaryl-C$_{1-4}$alkyl-carbonyl-amino-C$_{1-4}$ ₄alkyl, heterocyclyl, heterocyclyl-C₁₋₄alkyl, heterocyclyl-C₁₋₄alkoxy, phenyl, or phenyl-C₁₋₄alkoxy,
wherein heteroaryl is a saturated monocyclic or bicyclic ring system having 1, 2, or 3 heteroatom ring members selected from N, O, and S,
wherein heterocyclyl is a saturated or partially unsaturated monocyclic or bicyclic ring system having 1, 2, or 3 heteroatom ring members selected from N, O, and S, and
wherein each instance of phenyl, heteroaryl or heterocyclyl is optionally substituted with 1, or 2 substituents each selected from R₃;
R₂ is halogen, hydroxyl, cyano, oxo, hydroxyl-imino, C₁₋₄alkyl, halo-C₁₋₄alkyl, amino, C₁₋₄alkyl-amino, (C₁₋₄alkyl)₂-amino, amino-C₁₋₄alkyl, C₁₋₄alkyl-amino-C₁₋₄alkyl, (C₁₋₄alkyl)₂-amino-C₁₋₄alkyl, amino-carbonyl, hydroxyl-C₁₋₄alkyl, C₁₋₄alkoxy, C₁₋₄alkoxy-carbonyl, C₂₋₄alkenyl, C₃₋₇cycloalkyl, or heterocyclyl-C₁₋₄alkyl,
wherein heterocyclyl is a saturated or partially unsaturated monocyclic or bicyclic ring system having 1, 2, or 3 heteroatom ring members selected from N, O, and S, and
wherein each instance of heterocyclyl is optionally substituted with 1, or 2 substituents each selected from R₃;
R₃ is halogen, hydroxyl, nitro, oxo, hydroxyl-imino, C₁₋₄alkyl, halo-C₁₋₄alkyl, amino, C₁₋₄alkyl-amino, (C₁₋₄alkyl)₂-amino, amino-C₁₋₄alkyl, C₁₋₄alkyl-amino-C₁₋₄alkyl, (C₁₋₄alkyl)₂-amino-C₁₋₄alkyl, amino-carbonyl, C₁₋₄alkyl-amino-carbonyl, (C₁₋₄alkyl)₂-amino-carbonyl, C₁₋₄alkyl-amino-carbonyl-C₁₋₄alkyl, (C₁₋₄alkyl)₂-amino-carbonyl-C₁₋₄alkyl, C₁₋₄alkyl-carbonyl-amino, C₁₋₄alkyl-carbonyl-amino-C₁₋₄alkyl, hydroxyl-C₁₋₄alkyl, C₁₋₄alkyl-carbonyl, C₁₋₄alkoxy, halo-C₁₋₄alkoxy, amino-C₁₋₄alkoxy, hydroxyl-C₁₋₄alkoxy, C₁₋₄alkyl-C₁₋₄alkoxy, C₁₋₄alkyl-amino-C₁₋₄alkoxy, (C₁₋₄alkyl)₂-amino-C₁₋₄alkoxy, C₁₋₄alkyl-carbonyl-amino-C₁₋₄alkoxy, C₁₋₄alkoxy-C₁₋₄alkoxy, C₁₋₄alkoxy-carbonyl, C₁₋₄alkoxy-carbonyl-amino, C₁₋₄alkoxy-carbonyl-amino-C₁₋₄alkoxy, C₂₋₄alkenyl, C₂₋₄alkenyl-amino-carbonyl, C₃₋₇cycloalkyl, C₃₋₇cycloalkyl-C₁₋₄alkoxy, C₃₋₇cycloalkenyl, heteroaryl, heteroaryl-C₁₋₄alkyl, heteroaryl-C₁₋₄alkyl-amino, heteroaryl-C₁₋₄alkyl-amino-carbonyl, heteroaryl-C₁₋₄alkyl-carbonyl-amino, heteroaryl-C₁₋₄alkyl-amino-carbonyl-C₁₋₄alkyl, heteroaryl-C₁₋₄alkyl-carbonyl-amino-C₁₋₄alkyl, heterocyclyl, heterocyclyl-C₁₋₄alkyl, phenyl, or phenyl-C₁₋₄alkoxy;
R₄ is independently selected from halogen, C₁₋₄alkyl, hydroxyl-C₁₋₄alkyl, amino, C₁₋₄alkyl-amino, (C₁₋₄alkyl)₂-amino or hydroxyl-C₁₋₄alkyl-amino; and
R₅ is hydrogen, C₁₋₄alkyl, or hydroxyl-C₁₋₄alkyl;
wherein a form of the compound is selected from the group consisting of a prodrug, salt, hydrate, solvate, clathrate, isotopologue, racemate, enantiomer, diastereomer, stereoisomer, polymorph and tautomer form thereof.

In another aspect, provided herein is a method for modifying RNA splicing in order to modulate the amount of a mature mRNA transcript produced by a pre-mRNA transcript that is produced by a DNA sequence, the method comprising contacting the pre-mRNA transcript produced from the DNA sequence with a compound of Formula (I) or a form thereof, wherein the DNA sequence encodes two exons and an intron, wherein the nucleotide sequence encoding a first exon is upstream of the nucleotide sequence encoding the intron and the nucleotide sequence encoding a second exon is downstream of the nucleotide sequence encoding the intron, wherein the nucleotide sequence encoding the intron comprises a DNA nucleotide sequence comprising in 5' to 3' order: a nucleotide sequence encoding an endogenous or non-endogenous intronic recognition element for splicing modifier (iREMS), a nucleotide sequence encoding a branch point, and a nucleotide sequence encoding a 3' splice site, wherein the nucleotide sequence encoding the iREMS comprises a DNA sequence GAgtrngn, wherein r is adenine or guanine and n is any nucleotide, and wherein Formula (I) is:

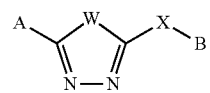

(I)

or a form thereof, wherein
W is CH=CH or S;
X is CH₂, CH(C₁₋₄alkyl), C(C₁₋₄alkyl)₂, CH=CH, O, NR₅, or a bond;
A is aryl, heteroaryl, heterocyclyl, or C₉₋₁₀cycloalkyl,
wherein aryl is selected from phenyl and naphthyl, each optionally substituted with 1, 2, 3, or 4 substituents each selected from R₁,
wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from R₁,
wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from R₂, and
wherein C₉₋₁₀cycloalkyl is a saturated or partially unsaturated bicyclic ring system optionally substituted with 1, 2, 3, 4, or 5 substituents each selected from R₂;
B is heterocyclyl,
wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from R₄;
R₁ is halogen, hydroxyl, cyano, C₁₋₄alkyl, halo-C₁₋₄alkyl, amino, C₁₋₄alkyl-amino, (C₁₋₄alkyl)₂-amino, amino-C₁₋₄alkyl, C₁₋₄alkyl-amino-C₁₋₄alkyl, (C₁₋₄alkyl)₂-amino-C₁₋₄alkyl, amino-carbonyl, C₁₋₄alkyl-amino-carbonyl, (C₁₋₄alkyl)₂-amino-carbonyl, C₁₋₄alkyl-amino-carbonyl-C₁₋₄alkyl, (C₁₋₄alkyl)₂-amino-carbonyl-C₁₋₄alkyl, C₁₋₄alkyl-carbonyl-amino, C₁₋₄alkyl-carbonyl-amino-C₁₋₄alkyl, hydroxyl-C₁₋₄alkyl, C₁₋₄alkyl-carbonyl, C₁₋₄alkoxy, halo-C₁₋₄alkoxy, amino-C₁₋₄alkoxy, hydroxyl-C₁₋₄alkoxy, C₁₋₄alkyl-C₁₋₄alkoxy, C₁₋₄alkyl-amino-C₁₋₄alkoxy, (C₁₋₄alkyl)₂-amino-C₁₋₄alkoxy, C₁₋₄alkyl-carbonyl-amino-C₁₋₄alkoxy, C₁₋₄alkoxy-C₁₋₄alkoxy, C₁₋₄alkoxy-carbonyl, C₁₋₄alkoxy-carbonyl-amino, C₁₋₄alkoxy-carbonyl-amino-C₁₋₄alkoxy, C₂₋₄alkenyl, C₂₋₄alkenyl-amino-carbonyl, C₃₋₇cycloalkyl, C₃₋₇cycloalkyl-C₁₋₄alkoxy, C₃₋₇cycloalkenyl, heteroaryl, heteroaryl-C₁₋₄alkyl, heteroaryl-C₁₋₄alkyl-amino, heteroaryl-C₁₋₄alkyl-amino-carbonyl, heteroaryl-C₁₋₄alkyl-carbonyl-amino, heteroaryl-C₁₋₄alkyl-amino-carbonyl-C₁₋₄alkyl, heteroaryl-C₁₋₄alkyl-carbonyl-amino-C₁₋₄alkyl, heterocyclyl, heterocyclyl-C₁₋₄alkyl, heterocyclyl-C₁₋₄alkoxy, phenyl, or phenyl-C₁₋₄alkoxy,
wherein heteroaryl is a saturated monocyclic or bicyclic ring system having 1, 2, or 3 heteroatom ring members selected from N, O, and S, wherein heterocyclyl is a saturated or partially unsaturated monocyclic or bicyclic ring system having 1, 2, or 3 heteroatom ring members selected from N, O, and S, and wherein each instance of phenyl, heteroaryl or heterocyclyl is optionally substituted with 1, or 2 substituents each selected from $R_3$;

$R_2$ is halogen, hydroxyl, cyano, oxo, hydroxyl-imino, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, hydroxyl-$C_{1-4}$alkyl, $C_{1-4}$alkoxy, $C_{1-4}$alkoxy-carbonyl, $C_{2-4}$alkenyl, $C_{3-7}$cycloalkyl, or heterocyclyl-$C_{1-4}$alkyl, wherein heterocyclyl is a saturated or partially unsaturated monocyclic or bicyclic ring system having 1, 2, or 3 heteroatom ring members selected from N, O, and S, and wherein each instance of heterocyclyl is optionally substituted with 1, or 2 substituents each selected from $R_3$;

$R_3$ is halogen, hydroxyl, nitro, oxo, hydroxyl-imino, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, $C_{1-4}$alkyl-amino-carbonyl, $(C_{1-4}$alkyl$)_2$-amino-carbonyl, $C_{1-4}$alkyl-amino-carbonyl-$C_{1-4}$alkyl, $(C_{1-4}$alkyl$)_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}$alkyl$)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, phenyl, or phenyl-$C_{1-4}$alkoxy;

$R_4$ is independently selected from halogen, $C_{1-4}$alkyl, hydroxyl-$C_{1-4}$alkyl, amino, $C_{1-4}$alkyl-amino, $(C_{1-4}$alkyl$)_2$-amino or hydroxyl-$C_{1-4}$alkyl-amino; and $R_5$ is hydrogen, $C_{1-4}$alkyl, or hydroxyl-$C_{1-4}$alkyl;

wherein a form of the compound is selected from the group consisting of a prodrug, salt, hydrate, solvate, clathrate, isotopologue, racemate, enantiomer, diastereomer, stereoisomer, polymorph and tautomer form thereof.

In a specific aspect of the foregoing aspect, the nucleotide sequence encoding the intron further comprises in 5' to 3' order: a nucleotide sequence encoding a 5' splice site, a nucleotide sequence encoding a branch point, and a nucleotide sequence encoding a 3' splice site upstream of the iREMS.

In another aspect, provided herein is a method for modifying RNA splicing in order to modulate the amount of a mature mRNA transcript produced by a pre-mRNA transcript that is produced by a DNA sequence, the method comprising contacting the pre-mRNA transcript produced from the DNA sequence with a compound of Formula (I) or a form thereof, wherein the DNA sequence encodes three exons and two introns, wherein the nucleotide sequences encoding the three exons and the two introns respectively are in the following order 5' to 3': a nucleotide sequence encoding a first exon, a nucleotide sequence encoding a first intron, a nucleotide sequence encoding a second exon, a nucleotide sequence encoding a second intron and a nucleotide sequence encoding a third exon, wherein the nucleotide sequence encoding the first intron comprises a DNA nucleotide sequence comprising in 5' to 3' order: a nucleotide sequence encoding a first 5' splice site, a nucleotide sequence encoding a first branch point and a nucleotide sequence encoding a first 3' splice site, wherein the nucleotide sequence encoding the second intron comprises a DNA nucleotide sequence comprising in 5' to 3' order: a nucleotide sequence encoding a second 5' splice site, a nucleotide sequence encoding an endogenous or non-endogenous intronic recognition element for splicing modifier (iREMS), a nucleotide sequence encoding a second branch point, and a nucleotide sequence encoding a second 3' splice site, wherein the nucleotide sequence encoding the iREMS comprises a DNA sequence GAgtrngn, wherein r is adenine or guanine and n is any nucleotide, and wherein Formula (I) is:

(I)

or a form thereof, wherein

W is CH=CH or S;

X is $CH_2$, $CH(C_{1-4}$alkyl$)$, $C(C_{1-4}$alkyl$)_2$, CH=CH, O, $NR_5$, or a bond;

A is aryl, heteroaryl, heterocyclyl, or $C_{9-10}$cycloalkyl, wherein aryl is selected from phenyl and naphthyl, each optionally substituted with 1, 2, 3, or 4 substituents each selected from $R_1$, wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from $R_1$, wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from $R_2$, and wherein $C_{9-10}$cycloalkyl is a saturated or partially unsaturated bicyclic ring system optionally substituted with 1, 2, 3, 4, or 5 substituents each selected from $R_2$;

B is heterocyclyl, wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from $R_4$;

$R_1$ is halogen, hydroxyl, cyano, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, $C_{1-4}$alkyl-amino-carbonyl, $(C_{1-4}$alkyl$)_2$-amino-carbonyl, $C_{1-4}$alkyl-amino-carbonyl-$C_{1-4}$alkyl, $(C_{1-4}$alkyl$)_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}$alkyl$)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-C$_{1-4}$alkyl-amino-carbonyl, heteroaryl-C$_{1-4}$alkyl-carbonyl-amino, heteroaryl-C$_{1-4}$alkyl-amino-carbonyl-C$_{1-4}$alkyl, heteroaryl-C$_{1-4}$alkyl-carbonyl-amino-C$_{1-4}$alkyl, heterocyclyl, heterocyclyl-C$_{1-4}$alkyl, heterocyclyl-C$_{1-4}$alkoxy, phenyl, or phenyl-C$_{1-4}$alkoxy,
wherein heteroaryl is a saturated monocyclic or bicyclic ring system having 1, 2, or 3 heteroatom ring members selected from N, O, and S,
wherein heterocyclyl is a saturated or partially unsaturated monocyclic or bicyclic ring system having 1, 2, or 3 heteroatom ring members selected from N, O, and S, and
wherein each instance of phenyl, heteroaryl or heterocyclyl is optionally substituted with 1, or 2 substituents each selected from R$_3$;
R$_2$ is halogen, hydroxyl, cyano, oxo, hydroxyl-imino, C$_{1-4}$alkyl, halo-C$_{1-4}$alkyl, amino, C$_{1-4}$alkyl-amino, (C$_{1-4}$alkyl)$_2$-amino, amino-C$_{1-4}$alkyl, C$_{1-4}$alkyl-amino-C$_{1-4}$alkyl, (C$_{1-4}$alkyl)$_2$-amino-C$_{1-4}$alkyl, amino-carbonyl, hydroxyl-C$_{1-4}$alkyl, C$_{1-4}$alkoxy, C$_{1-4}$alkoxy-carbonyl, C$_{2-4}$alkenyl, C$_{3-7}$cycloalkyl, or heterocyclyl-C$_{1-4}$alkyl,
wherein heterocyclyl is a saturated or partially unsaturated monocyclic or bicyclic ring system having 1, 2, or 3 heteroatom ring members selected from N, O, and S, and
wherein each instance of heterocyclyl is optionally substituted with 1, or 2 substituents each selected from R$_3$;
R$_3$ is halogen, hydroxyl, nitro, oxo, hydroxyl-imino, C$_{1-4}$alkyl, halo-C$_{1-4}$alkyl, amino, C$_{1-4}$alkyl-amino, (C$_{1-4}$alkyl)$_2$-amino, amino-C$_{1-4}$alkyl, C$_{1-4}$alkyl-amino-C$_{1-4}$alkyl, (C$_{1-4}$alkyl)$_2$-amino-C$_{1-4}$alkyl, amino-carbonyl, C$_{1-4}$alkyl-amino-carbonyl, (C$_{1-4}$alkyl)$_2$-amino-carbonyl, C$_{1-4}$alkyl-amino-carbonyl-C$_{1-4}$alkyl, (C$_{1-4}$alkyl)$_2$-amino-carbonyl-C$_{1-4}$alkyl, C$_{1-4}$alkyl-carbonyl-amino, C$_{1-4}$alkyl-carbonyl-amino-C$_{1-4}$alkyl, hydroxyl-C$_{1-4}$alkyl, C$_{1-4}$alkyl-carbonyl, C$_{1-4}$alkoxy, halo-C$_{1-4}$alkoxy, amino-C$_{1-4}$alkoxy, hydroxyl-C$_{1-4}$alkoxy, C$_{1-4}$alkyl-C$_{1-4}$alkoxy, C$_{1-4}$alkyl-amino-C$_{1-4}$alkoxy, (C$_{1-4}$alkyl)$_2$-amino-C$_{1-4}$alkoxy, C$_{1-4}$alkyl-carbonyl-amino-C$_{1-4}$alkoxy, C$_{1-4}$alkoxy-C$_{1-4}$alkoxy, C$_{1-4}$alkoxy-carbonyl, C$_{1-4}$alkoxy-carbonyl-amino, C$_{1-4}$alkoxy-carbonyl-amino-C$_{1-4}$alkoxy, C$_{2-4}$alkenyl, C$_{2-4}$alkenyl-amino-carbonyl, C$_{3-7}$cycloalkyl, C$_{3-7}$cycloalkyl-C$_{1-4}$alkoxy, C$_{3-7}$cycloalkenyl, heteroaryl, heteroaryl-C$_{1-4}$alkyl, heteroaryl-C$_{1-4}$alkyl-amino, heteroaryl-C$_{1-4}$alkyl-amino-carbonyl, heteroaryl-C$_{1-4}$alkyl-carbonyl-amino, heteroaryl-C$_{1-4}$alkyl-amino-carbonyl-C$_{1-4}$alkyl, heteroaryl-C$_{1-4}$alkyl-carbonyl-amino-C$_{1-4}$alkyl, heterocyclyl, heterocyclyl-C$_{1-4}$alkyl, phenyl, or phenyl-C$_{1-4}$alkoxy;
R$_4$ is independently selected from halogen, C$_{1-4}$alkyl, hydroxyl-C$_{1-4}$alkyl, amino, C$_{1-4}$alkyl-amino, (C$_{1-4}$alkyl)$_2$-amino or hydroxyl-C$_{1-4}$alkyl-amino; and
R$_5$ is hydrogen, C$_{1-4}$alkyl, or hydroxyl-C$_{1-4}$alkyl;
wherein a form of the compound is selected from the group consisting of a prodrug, salt, hydrate, solvate, clathrate, isotopologue, racemate, enantiomer, diastereomer, stereoisomer, polymorph and tautomer form thereof.
In a specific aspect, the pre-mRNA transcript is in a cell or a lysate of the cell and the method comprises contacting the compound with the cell or cell lysate. In a specific aspect, the method modulates the amount and/or modifies the type of a protein produced from the mature mRNA transcript and produced in the cell or lysate of the cell.
In a specific aspect, the method comprises administering the compound to a subject. In a specific aspect, the method modulates the amount and/or modifies the type of a protein produced from the mature mRNA transcript and produced in the subject. In one aspect, the subject is a non-human subject. In another aspect, the subject is a human subject.

In a specific aspect, the mature mRNA transcript encodes a detectable reporter protein.
In another aspect, provided herein is a method for modifying RNA splicing in order to prevent or treat a disease or disorder in which a change in the level of expression of one, two, three or more RNA isoforms encoded by a gene is beneficial to the prevention or treatment of the disease, the method comprising administering a compound described herein to a subject in need thereof, wherein the one, two, three or more RNA isoforms are produced from a pre-mRNA transcript that is produced from a DNA sequence encoding two exons and an intron, wherein the nucleotide sequence encoding a first exon is upstream of the nucleotide sequence encoding the intron and the nucleotide sequence encoding a second exon is downstream of the nucleotide sequence encoding the intron, wherein the nucleotide sequence encoding the intron comprises in 5' to 3' order: a nucleotide sequence encoding a first 5' splice site, a nucleotide sequence encoding a first branch point, a nucleotide sequence encoding a first 3' splice site, a nucleotide sequence encoding an intronic recognition element for splicing modifier (iREMS), a nucleotide sequence encoding a second branch point, and a nucleotide sequence encoding a second 3' splice site, wherein the nucleotide sequence encoding the iREMS comprises a DNA sequence GAgtrngn, wherein r is adenine or guanine and n is any nucleotide, and wherein Formula (I) is:

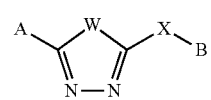

(I)

or a form thereof, wherein
W is CH=CH or S;
X is CH$_2$, CH(C$_{1-4}$alkyl), C(C$_{1-4}$alkyl), CH=CH, O, NR$_5$, or a bond;
A is aryl, heteroaryl, heterocyclyl, or C$_{9-10}$cycloalkyl,
wherein aryl is selected from phenyl and naphthyl, each optionally substituted with 1, 2, 3, or 4 substituents each selected from R$_1$,
wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from R$_1$,
wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from R$_2$, and
wherein C$_{9-10}$cycloalkyl is a saturated or partially unsaturated bicyclic ring system optionally substituted with 1, 2, 3, 4, or 5 substituents each selected from R$_2$;
B is heterocyclyl,
wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from R$_4$;
R$_1$ is halogen, hydroxyl, cyano, C$_{1-4}$alkyl, halo-C$_{1-4}$alkyl, amino, C$_{1-4}$alkyl-amino, (C$_{1-4}$alkyl)$_2$-amino, amino-C$_{1-4}$alkyl, C$_{1-4}$alkyl-amino-C$_{1-4}$alkyl, (C$_{1-4}$alkyl)$_2$-amino-C$_{1-4}$alkyl, amino-carbonyl, C$_{1-4}$alkyl-amino-carbonyl, (C$_{1-4}$alkyl)$_2$-amino-carbonyl, C$_{1-4}$alkyl-amino-carbonyl- C$_{1-4}$alkyl, (C$_{1-4}$alkyl)$_2$-amino-carbonyl-C$_{1-4}$alkyl, C$_{1-4}$alkyl-carbonyl-amino, C$_{1-4}$alkyl-carbonyl-amino-C$_{1-4}$alkyl, hydroxyl-C$_{1-4}$alkyl, C$_{1-4}$alkyl-carbonyl, C$_{1-4}$alkoxy, halo-C$_{1-4}$alkoxy, amino-C$_{1-4}$alkoxy, hydroxyl-C$_{1-4}$alkoxy, C$_{1-4}$alkyl-C$_{1-4}$alkoxy, C$_{1-4}$alkyl-amino-C$_{1-4}$alkoxy, (C$_{1-4}$alkyl)$_2$-amino-C$_{1-4}$alkoxy, C$_{1-4}$alkyl-carbonyl-amino-C$_{1-4}$alkoxy, C$_{1-4}$alkoxy-C$_{1-4}$alkoxy, C$_{1-4}$alkoxy-carbonyl, C$_{1-4}$alkoxy-carbonyl-amino, C$_{1-4}$alkoxy-carbonyl-amino-C$_{1-4}$alkoxy, C$_{2-4}$alkenyl, C$_{2-4}$alkenyl-amino-carbonyl, C$_{3-7}$cycloalkyl, C$_{3-7}$cycloalkyl-C$_{1-4}$alkoxy, C$_{3-7}$cycloalkenyl, heteroaryl, heteroaryl-C$_{1-4}$alkyl, heteroaryl-C$_{1-4}$alkyl-amino, heteroaryl-C$_{1-4}$alkyl-amino-carbonyl, heteroaryl-C$_{1-4}$alkyl-carbonyl-amino, heteroaryl-C$_{1-4}$alkyl-amino-carbonyl-C$_{1-4}$alkyl, heteroaryl-C$_{1-4}$alkyl-carbonyl-amino-C$_{1-4}$alkyl, heterocyclyl, heterocyclyl-C$_{1-4}$alkyl, heterocyclyl-C$_{1-4}$alkoxy, phenyl, or phenyl-C$_{1-4}$alkoxy, wherein heteroaryl is a saturated monocyclic or bicyclic ring system having 1, 2, or 3 heteroatom ring members selected from N, O, and S, wherein heterocyclyl is a saturated or partially unsaturated monocyclic or bicyclic ring system having 1, 2, or 3 heteroatom ring members selected from N, O, and S, and wherein each instance of phenyl, heteroaryl or heterocyclyl is optionally substituted with 1, or 2 substituents each selected from R$_3$;

R$_2$ is halogen, hydroxyl, cyano, oxo, hydroxyl-imino, C$_{1-4}$alkyl, halo-C$_{1-4}$alkyl, amino, C$_{1-4}$alkyl-amino, (C$_{1-4}$alkyl)$_2$-amino, amino-C$_{1-4}$alkyl, C$_{1-4}$alkyl-amino-C$_{1-4}$alkyl, (C$_{1-4}$alkyl)$_2$-amino-C$_{1-4}$alkyl, amino-carbonyl, hydroxyl-C$_{1-4}$alkyl, C$_{1-4}$alkoxy, C$_{1-4}$alkoxy-carbonyl, C$_{2-4}$alkenyl, C$_{3-7}$cycloalkyl, or heterocyclyl-C$_{1-4}$alkyl, wherein heterocyclyl is a saturated or partially unsaturated monocyclic or bicyclic ring system having 1, 2, or 3 heteroatom ring members selected from N, O, and S, and wherein each instance of heterocyclyl is optionally substituted with 1, or 2 substituents each selected from R$_3$;

R$_3$ is halogen, hydroxyl, nitro, oxo, hydroxyl-imino, C$_{1-4}$alkyl, halo-C$_{1-4}$alkyl, amino, C$_{1-4}$alkyl-amino, (C$_{1-4}$alkyl)$_2$-amino, amino-C$_{1-4}$alkyl, C$_{1-4}$alkyl-amino-C$_{1-4}$alkyl, (C$_{1-4}$alkyl)$_2$-amino-C$_{1-4}$alkyl, amino-carbonyl, C$_{1-4}$alkyl-amino-carbonyl, (C$_{1-4}$alkyl)$_2$-amino-carbonyl, C$_{1-4}$alkyl-amino-carbonyl-C$_{1-4}$alkyl, (C$_{1-4}$alkyl)$_2$-amino-carbonyl-C$_{1-4}$alkyl, C$_{1-4}$alkyl-carbonyl-amino, C$_{1-4}$alkyl-carbonyl-amino-C$_{1-4}$alkyl, hydroxyl-C$_{1-4}$alkyl, C$_{1-4}$alkyl-carbonyl, C$_{1-4}$alkoxy, halo-C$_{1-4}$alkoxy, amino-C$_{1-4}$alkoxy, hydroxyl-C$_{1-4}$alkoxy, C$_{1-4}$alkyl-C$_{1-4}$alkoxy, C$_{1-4}$alkyl-amino-C$_{1-4}$alkoxy, (C$_{1-4}$alkyl)$_2$-amino-C$_{1-4}$alkoxy, C$_{1-4}$alkyl-carbonyl-amino-C$_{1-4}$alkoxy, C$_{1-4}$alkoxy-C$_{1-4}$alkoxy, C$_{1-4}$alkoxy-carbonyl, C$_{1-4}$alkoxy-carbonyl-amino, C$_{1-4}$alkoxy-carbonyl-amino-C$_{1-4}$alkoxy, C$_{2-4}$alkenyl, C$_{2-4}$alkenyl-amino-carbonyl, C$_{3-7}$cycloalkyl, C$_{3-7}$cycloalkyl-C$_{1-4}$alkoxy, C$_{3-7}$cycloalkenyl, heteroaryl, heteroaryl-C$_{1-4}$alkyl, heteroaryl-C$_{1-4}$alkyl-amino, heteroaryl-C$_{1-4}$alkyl-amino-carbonyl, heteroaryl-C$_{1-4}$alkyl-carbonyl-amino, heteroaryl-C$_{1-4}$alkyl-amino-carbonyl-C$_{1-4}$alkyl, heteroaryl-C$_{1-4}$alkyl-carbonyl-amino-C$_{1-4}$alkyl, heterocyclyl, heterocyclyl-C$_{1-4}$alkyl, phenyl, or phenyl-C$_{1-4}$alkoxy;

R$_4$ is independently selected from halogen, C$_{1-4}$alkyl, hydroxyl-C$_{1-4}$alkyl, amino, C$_{1-4}$alkyl-amino, (C$_{1-4}$alkyl)$_2$-amino or hydroxyl-C$_{1-4}$alkyl-amino; and R$_5$ is hydrogen, C$_{1-4}$alkyl, or hydroxyl-C$_{1-4}$alkyl;

wherein a form of the compound is selected from the group consisting of a prodrug, salt, hydrate, solvate, clathrate, isotopologue, racemate, enantiomer, diastereomer, stereoisomer, polymorph and tautomer form thereof.

In another aspect, provided herein is a method for modifying RNA splicing in order to prevent or treat a disease or disorder in which a change in the level of expression of one, two, three or more RNA isoforms encoded by a gene is beneficial to the prevention or treatment of the disease, the method comprising administering a compound described herein to a subject in need thereof, wherein the one, two, three or more RNA isoforms are produced from a pre-mRNA transcript that is produced from a DNA sequence encoding two exons and an intron, wherein the nucleotide sequence encoding a first exon is upstream of the nucleotide sequence encoding the intron and the nucleotide sequence encoding a second exon is downstream of the nucleotide sequence encoding the intron, wherein the nucleotide sequence encoding the intron comprises a DNA nucleotide sequence comprising in 5' to 3' order: a nucleotide sequence encoding an intronic recognition element for splicing modifier (iREMS), a nucleotide sequence encoding a branch point, and a nucleotide sequence encoding a 3' splice site, wherein the nucleotide sequence encoding the iREMS comprises a DNA sequence GAgtrngn, wherein r is adenine or guanine and n is any nucleotide, and wherein Formula (I) is:

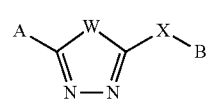

(I)

or a form thereof, wherein

W is CH=CH or S;

X is CH$_2$, CH(C$_{1-4}$alkyl), C(C$_{1-4}$alkyl)$_2$, CH=CH, O, NR$_5$, or a bond;

A is aryl, heteroaryl, heterocyclyl, or C$_{9-10}$cycloalkyl, wherein aryl is selected from phenyl and naphthyl, each optionally substituted with 1, 2, 3, or 4 substituents each selected from R$_1$, wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from R$_1$, wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from R$_2$, and wherein C$_{9-10}$cycloalkyl is a saturated or partially unsaturated bicyclic ring system optionally substituted with 1, 2, 3, 4, or 5 substituents each selected from R$_2$;

B is heterocyclyl, wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from R$_4$;

R$_1$ is halogen, hydroxyl, cyano, C$_{1-4}$alkyl, halo-C$_{1-4}$alkyl, amino, C$_{1-4}$alkyl-amino, (C$_{1-4}$alkyl)$_2$-amino, amino-C$_{1-4}$alkyl, C$_{1-4}$alkyl-amino-C$_{1-4}$alkyl, (C$_{1-4}$alkyl)$_2$-amino-C$_{1-4}$alkyl, amino-carbonyl, C$_{1-4}$alkyl-amino-carbonyl, (C$_{1-4}$alkyl)$_2$-amino-carbonyl, C$_{1-4}$alkyl-amino-carbonyl-C$_{1-4}$alkyl, (C$_{1-4}$alkyl)$_2$-amino-carbonyl-C$_{1-4}$alkyl, C$_{1-4}$alkyl-carbonyl-amino, C$_{1-4}$alkyl-carbonyl-amino-C$_{1-4}$alkyl, hydroxyl-C$_{1-4}$alkyl, C$_{1-4}$alkyl-carbonyl, C$_{1-4}$alkoxy, halo-C$_{1-4}$alkoxy, amino-C$_{1-4}$alkoxy, hydroxyl-C$_{1-4}$alkoxy, C$_{1-4}$alkyl-C$_{1-4}$alkoxy, C$_{1-4}$alkyl-amino-C$_{1-4}$alkoxy, $_4$alkoxy, $(C_{1-4}alkyl)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, heterocyclyl-$C_{1-4}$alkoxy, phenyl, or phenyl-$C_{1-4}$alkoxy, wherein heteroaryl is a saturated monocyclic or bicyclic ring system having 1, 2, or 3 heteroatom ring members selected from N, O, and S, wherein heterocyclyl is a saturated or partially unsaturated monocyclic or bicyclic ring system having 1, 2, or 3 heteroatom ring members selected from N, O, and S, and wherein each instance of phenyl, heteroaryl or heterocyclyl is optionally substituted with 1, or 2 substituents each selected from $R_3$;

$R_2$ is halogen, hydroxyl, cyano, oxo, hydroxyl-imino, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, hydroxyl-$C_{1-4}$alkyl, $C_{1-4}$alkoxy, $C_{1-4}$alkoxy-carbonyl, $C_{2-4}$alkenyl, $C_{3-7}$cycloalkyl, or heterocyclyl-$C_{1-4}$alkyl, wherein heterocyclyl is a saturated or partially unsaturated monocyclic or bicyclic ring system having 1, 2, or 3 heteroatom ring members selected from N, O, and S, and wherein each instance of heterocyclyl is optionally substituted with 1, or 2 substituents each selected from $R_3$;

$R_3$ is halogen, hydroxyl, nitro, oxo, hydroxyl-imino, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, $C_{1-4}$alkyl-amino-carbonyl, $(C_{1-4}$alkyl$)_2$-amino-carbonyl, $C_{1-4}$alkyl-amino-carbonyl-$C_{1-4}$alkyl, $(C_{1-4}$alkyl$)_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}$alkyl$)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, phenyl, or phenyl-$C_{1-4}$alkoxy;

$R_4$ is independently selected from halogen, $C_{1-4}$alkyl, hydroxyl-$C_{1-4}$alkyl, amino, $C_{1-4}$alkyl-amino, $(C_{1-4}$alkyl$)_2$-amino or hydroxyl-$C_{1-4}$alkyl-amino; and $R_5$ is hydrogen, $C_{1-4}$alkyl, or hydroxyl-$C_{1-4}$alkyl;

wherein a form of the compound is selected from the group consisting of a prodrug, salt, hydrate, solvate, clathrate, isotopologue, racemate, enantiomer, diastereomer, stereoisomer, polymorph and tautomer form thereof.

In a specific aspect of the foregoing aspect, the nucleotide sequence encoding the intron further comprises in 5' to 3' order: a nucleotide sequence encoding a 5' splice site, a nucleotide sequence encoding a branch point, and a nucleotide sequence encoding a 3' splice site upstream of the nucleotide sequence encoding the iREMS.

In another aspect, provided herein is a method for modifying RNA splicing in order to prevent or treat a disease or disorder in which a change in the level of expression of one, two, three or more RNA isoforms encoded by a gene is beneficial to the prevention or treatment of the disease, the method comprising administering a compound described herein to a subject in need thereof, wherein the one, two, three or more RNA isoforms are produced from a pre-mRNA transcript that is produced from a DNA sequence encoding three exons and two introns, wherein the nucleotide sequences encoding the three exons and the two introns respectively are in the following order 5' to 3': a nucleotide sequence encoding a first exon, a nucleotide sequence encoding a first intron, a nucleotide sequence encoding a second exon, a nucleotide sequence encoding a second intron and a nucleotide sequence encoding a third exon, wherein the nucleotide sequence encoding the first intron comprises a DNA nucleotide sequence comprising in 5' to 3' order: a nucleotide sequence encoding a first 5' splice site, a nucleotide sequence encoding a first branch point and a nucleotide sequence encoding a first 3' splice site, wherein the nucleotide sequence encoding the second intron comprises a DNA nucleotide sequence comprising in 5' to 3' order: a nucleotide sequence encoding a second 5' splice site, a nucleotide sequence encoding an intronic recognition element for splicing modifier (iREMS), a nucleotide sequence encoding a second branch point, and a nucleotide sequence encoding a second 3' splice site, wherein the nucleotide sequence encoding the iREMS comprises a DNA sequence GAgtrngn, wherein r is adenine or guanine and n is any nucleotide, and wherein Formula (I) is:

(I)

or a form thereof, wherein

W is CH=CH or S;

X is $CH_2$, $CH(C_{1-4}alkyl)$, $C(C_{1-4}alkyl)_2$, CH=CH, O, $NR_5$, or a bond;

A is aryl, heteroaryl, heterocyclyl, or $C_{9-10}$cycloalkyl,
  wherein aryl is selected from phenyl and naphthyl, each optionally substituted with 1, 2, 3, or 4 substituents each selected from $R_1$,
  wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from $R_1$,
  wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from $R_2$, and
  wherein $C_{9-10}$cycloalkyl is a saturated or partially unsaturated bicyclic ring system optionally substituted with 1, 2, 3, 4, or 5 substituents each selected from $R_2$;

B is heterocyclyl,
  wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from $R_4$;

$R_1$ is halogen, hydroxyl, cyano, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, $C_{1-4}$alkyl-amino-carbonyl, $(C_{1-4}$alkyl$)_2$-amino-carbonyl, $C_{1-4}$alkyl-amino-carbonyl-$C_{1-4}$alkyl, $(C_{1-4}$alkyl$)_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}$alkyl$)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, heterocyclyl-$C_{1-4}$alkoxy, phenyl, or phenyl-$C_{1-4}$alkoxy, wherein heteroaryl is a saturated monocyclic or bicyclic ring system having 1, 2, or 3 heteroatom ring members selected from N, O, and S, wherein heterocyclyl is a saturated or partially unsaturated monocyclic or bicyclic ring system having 1, 2, or 3 heteroatom ring members selected from N, O, and S, and wherein each instance of phenyl, heteroaryl or heterocyclyl is optionally substituted with 1, or 2 substituents each selected from $R_3$;

$R_2$ is halogen, hydroxyl, cyano, oxo, hydroxyl-imino, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, hydroxyl-$C_{1-4}$alkyl, $C_{1-4}$alkoxy, $C_{1-4}$alkoxy-carbonyl, $C_{2-4}$alkenyl, $C_{3-7}$cycloalkyl, or heterocyclyl-$C_{1-4}$alkyl, wherein heterocyclyl is a saturated or partially unsaturated monocyclic or bicyclic ring system having 1, 2, or 3 heteroatom ring members selected from N, O, and S, and wherein each instance of heterocyclyl is optionally substituted with 1, or 2 substituents each selected from $R_3$;

$R_3$ is halogen, hydroxyl, nitro, oxo, hydroxyl-imino, $C_{1-4}$alkyl, halo-$C_{1-4}$alkyl, amino, $C_{1-4}$alkyl-amino, $(C_{1-4}$alkyl$)_2$-amino, amino-$C_{1-4}$alkyl, $C_{1-4}$alkyl-amino-$C_{1-4}$alkyl, $(C_{1-4}$alkyl$)_2$-amino-$C_{1-4}$alkyl, amino-carbonyl, $C_{1-4}$alkyl-amino-carbonyl, $(C_{1-4}$alkyl$)_2$-amino-carbonyl, $C_{1-4}$alkyl-amino-carbonyl-$C_{1-4}$alkyl, $(C_{1-4}$alkyl$)_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}$alkyl$)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, phenyl, or phenyl-$C_{1-4}$alkoxy;

$R_4$ is independently selected from halogen, $C_{1-4}$alkyl, hydroxyl-$C_{1-4}$alkyl, amino, $C_{1-4}$alkyl-amino, $(C_{1-4}$alkyl$)_2$-amino or hydroxyl-$C_{1-4}$alkyl-amino; and $R_5$ is hydrogen, $C_{1-4}$alkyl, or hydroxyl-$C_{1-4}$alkyl;

wherein a form of the compound is selected from the group consisting of a prodrug, salt, hydrate, solvate, clathrate, isotopologue, racemate, enantiomer, diastereomer, stereoisomer, polymorph and tautomer form thereof.

In some aspects, the nucleotide sequence encoding the iREMS is an endogenous nucleotide sequence encoding the iREMS. In other aspects, the nucleotide sequence encoding the iREMS is a non-endogenous nucleotide sequence encoding the iREMS.

In another aspect, provided herein is an artificial gene construct comprising a DNA sequence encoding exons and one or more introns, wherein the nucleotide sequence encoding at least one intron comprises a nucleotide sequence encoding an iREMS that is downstream of a nucleotide sequence encoding a branch point and a nucleotide sequence encoding a 3' splice site, and wherein the nucleotide sequence encoding the iREMS comprises the sequence GAgtrngn, wherein r is adenine or guanine and n is any nucleotide.

In another aspect, provided herein is an artificial gene construct comprising a DNA sequence encoding two exons and an intron, wherein the nucleotide sequence encoding a first exon is upstream of the nucleotide sequence encoding the intron and the nucleotide sequence encoding a second exon is downstream of the nucleotide sequence encoding the intron, wherein the DNA nucleotide sequence encoding the intron comprises in 5' to 3' order: a nucleotide sequence encoding a first 5' splice site, a nucleotide sequence encoding a first branch point, a nucleotide sequence encoding a first 3' splice site, a nucleotide sequence encoding an iREMS, a nucleotide sequence encoding a second branch point and a nucleotide sequence encoding a second 3' splice site, wherein the nucleotide sequence encoding the iREMS comprises a DNA sequence GAgtrngn, wherein r is adenine or guanine and n is any nucleotide.

In another aspect, provided herein is an artificial gene construct comprising a DNA sequence encoding two exons and an intron, wherein the nucleotide sequence encoding a first exon is upstream of the nucleotide sequence encoding the intron and the nucleotide sequence encoding a second exon is downstream of the nucleotide sequence encoding the intron, wherein the DNA nucleotide sequence encoding the intron comprises in 5' to 3' order: a nucleotide sequence encoding an iREMS, a nucleotide sequence encoding a branch point and a nucleotide sequence encoding a 3' splice site, wherein the nucleotide sequence encoding the iREMS comprises a DNA sequence GAgtrngn, wherein r is adenine or guanine and n is any nucleotide.

In another aspect, provided herein is a cell comprising an artificial gene construct described herein.

In a specific aspect, the nucleotide sequence encoding the iREMS comprises a DNA sequence GAgtragu, wherein r is adenine or guanine.

In another specific aspect, the nucleotide sequence encoding the iREMS comprises a DNA sequence NNGAgtrngn (SEQ ID NO: 1808), wherein r is adenine or guanine and n or N is any nucleotide. In a specific aspect, the DNA sequence NNGAgtrngn (SEQ ID NO: 1808) is selected from the group consisting of ANGAgtrngn (SEQ ID NO: 1809), CNGAgtrngn (SEQ ID NO: 1810), GNGAgtrngn (SEQ ID NO: 1811), TNGAgtrngn (SEQ ID NO: 1812), NAGAgtrngn (SEQ ID NO: 1813), NCGAgtrngn (SEQ ID NO: 1814), NGGAgtrngn (SEQ ID NO: 1815), NTGAgtrngn (SEQ ID NO: 1816), AAGAgtrngn (SEQ ID NO: 1817), ACGAgtrngn (SEQ ID NO: 1818), AGGAgtrngn (SEQ ID NO: 1819), ATGAgtrngn (SEQ ID NO: 1820), CAGAgtrngn (SEQ ID NO: 1821), CCGAgtrngn (SEQ ID NO: 1822), CGGAgtrngn (SEQ ID NO: 1823), CTGAgtrngn (SEQ ID NO: 1824), GAGAgtrngn (SEQ ID NO: 1825), GCGAgtrngn (SEQ ID NO: 1826), GGGAgtrngn (SEQ ID NO: 1827), GTGAgtrngn (SEQ ID NO: 1828), TAGAgtrngn (SEQ ID NO: 1829), TCGAgtrngn (SEQ ID NO: 1830), TGGAgtrngn (SEQ ID NO: 1831) and TTGAgtrngn (SEQ ID NO: 1832), wherein r is adenine or guanine and n or N is any nucleotide.

In another specific aspect, the nucleotide sequence encoding the iREMS comprises a DNA sequence NNGAgtragu (SEQ ID NO: 3609), wherein r is adenine or guanine and N is any nucleotide. In a specific aspect, the DNA sequence NNGAgtragu (SEQ ID NO: 3609) is selected from the group consisting of ANGAgtragu (SEQ ID NO: 3610), CNGAgtragu (SEQ ID NO: 3611), GNGAgtragu (SEQ ID NO: 3612), TNGAgtragu (SEQ ID NO: 3613), NAGAgtragu (SEQ ID NO: 3614), NCGAgtragu (SEQ ID NO: 3615), NGGAgtragu (SEQ ID NO: 3616), NTGAgtragu (SEQ ID NO: 3617), AAGAgtragu (SEQ ID NO: 3618), ACGAgtragu (SEQ ID NO: 3619), AGGAgtragu (SEQ ID NO: 3620), ATGAgtragu (SEQ ID NO: 3621), CAGAgtragu (SEQ ID NO: 3622), CCGAgtragu (SEQ ID NO: 3623), CGGAgtragu (SEQ ID NO: 3624), CTGAgtragu (SEQ ID NO: 3625), GAGAgtragu (SEQ ID NO: 3626), GCGAgtragu (SEQ ID NO: 3627), GGGAgtragu (SEQ ID NO: 3628), GTGAgtragu (SEQ ID NO: 3629), TAGAgtragu (SEQ ID NO: 3630), TCGAgtragu (SEQ ID NO: 3631), TGGAgtragu (SEQ ID NO: 3632) and TTGAgtragu (SEQ ID NO: 3633), wherein r is adenine or guanine, and N is any nucleotide.

In certain aspects, n is adenine or guanine.

In a specific aspect, the pre-mRNA transcript described herein is a pre-mRNA transcript of a gene that is not selected from: ABHD10, ADAM12, AKT1, ANXA11, APLP2, APPL2, ARMCX6, ATG5, AXIN1, BAIAP2, CCNB1IP1, CCT7, CEP57, CSF1, DLGAP4, EPN1, ERGIC3, FOXM1, GGCT, GRAMD3, HSD17B4, LARP7, LRRC42, MADD, MAN1B1, MRPL39, PCBP4, PPHLN1, PRKACB, RAB23, RAP1A, RCC1, SMN2, SREK1, STRN3 and TNRC6A.

BRIEF DESCRIPTION OF THE DRAWINGS

FIGS. 2A, 2B, 3A, 3B, 4A, 4B, 5A, 5B and 6A. The dose dependent production of iExons for certain genes in SH-SY5Y cells treated for 20 hours with a compound described herein are shown in FIGS. 2A, 2B, 3A, 3B, 4A, 4B. The dose dependent production of iExons for certain genes in GM04856 cells treated for 20 hours with a compound described herein are shown in FIGS. 5A and 5B. The dose dependent production of iExons for the gene ELMO2 in SH-SY5Y cells treated for 20 hours with a compound described herein is shown in FIG. 6A. For each Figure, end-point RT-PCR from total RNA showed the resulting bands of interest for each gene, as indicated by open and closed arrowheads, where an open arrowhead represents an exon isoform where endogenous wild-type splicing occurred; and, where a closed arrowhead represents an exon isoform having an iExon included in the mRNA. In all cases, an increase in compound concentration resulted in the appearance of a slower migrating PCR product containing the intronic-derived exon, where the additional bands seen are intermediate spliced products. The asterisk (*) in some Figures represents an event where the targeted exon was skipped. Accordingly, the result for each gene demonstrates a statistically significant splicing event that represents various aspects of the operation of an intronic REMS in combination with splicing modifier compounds as described herein.

FIGS. 6B and 6C. Production of certain intronic exon isoforms for ELMO2 in the presence of one or more compounds described herein are shown in these schematics, where the presence of each isoform demonstrates a statistically significant splicing event that represents various aspects of the interactions of an intronic REMS sequence, where one or more branch points and one or more 3' splice sites in the presence of compounds as described herein are shown.

INTRONIC RECOGNITION ELEMENTS FOR SPLICING MODIFIER (iREMS)

Figure 1A:
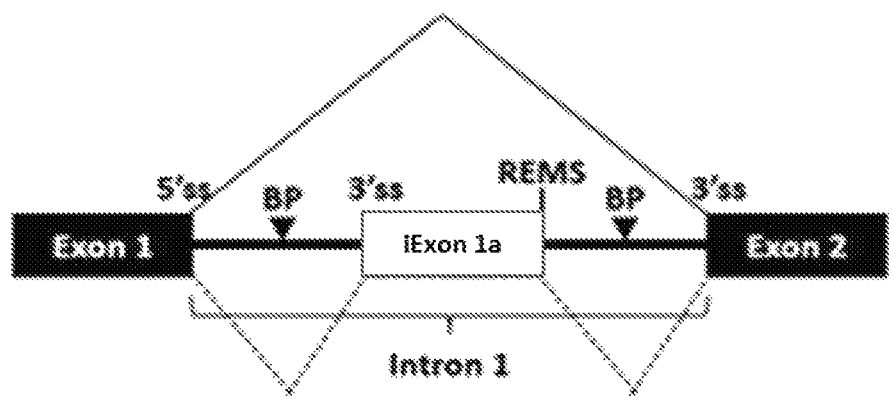
FIGS. 1A-1C. Representative schematics of intronic exon splicing mediated by an intronic REMS, where 5' ss represents a 5' splice site; 3' ss represents a 3' splice site; BP represents a splicing branch point; Exon 1e and Exon 2e represent eExons; and, iExon 1a represents an intronic exon. Splicing events mediated by an intronic REMS in the absence of a compound described herein are illustrated by solid lines that connect exons, splicing events mediated by an intronic REMS in the presence of a compound described herein are illustrated by dashed lines connecting exons and eExons or iExons.

In one aspect, provided herein is an intronic recognition element for splicing modifier (otherwise referred to as "iREMS") having elements capable of being recognized by a small molecule splicing modifier, whereby the elements of the associated iREMS complex, in combination with the small molecule splicing modifier, affect interactions with the spliceosome as further described herein. In a specific aspect, the intronic REMS has the nucleotide sequence GAgurngn at the RNA level, wherein r is A or G (i.e., a purine nucleotide adenine or guanine) and n is any nucleotide. In another specific aspect, the intronic REMS has the nucleotide sequence GAguragu at the RNA level, wherein r is adenine or guanine. In one or more of such specific aspects provided herein, n is adenine or guanine. In a more specific aspect, the intronic REMS has the nucleotide sequence NNGAgurngn (SEQ ID NO: 1) at the RNA level, wherein r is A or G (i.e., a purine nucleotide adenine or guanine) and n or N is any nucleotide. In another more specific aspect, the intronic REMS has the nucleotide sequence NNGAguragu (SEQ ID NO: 2) at the RNA level, wherein r is adenine or guanine and N is any nucleotide. In one or more of such more specific aspects provided herein, N is adenine or guanine. In another specific aspect, the intronic REMS is downstream of an intronic branch point and a functional intronic 3' splice site, wherein the intronic REMS comprises a nucleotide sequence selected from the group consisting of ANGAgurngn (SEQ ID NO: 4), CNGAgurngn (SEQ ID NO: 5), GNGAgurngn (SEQ ID NO: 6), UNGAgurngn (SEQ ID NO: 7), NAGAgurngn (SEQ ID NO: 8), NCGAgurngn (SEQ ID NO: 9), NGGAgurngn (SEQ ID NO: 10), NUGAgurngn (SEQ ID NO: 11), AAGAgurngn (SEQ ID NO: 12), ACGAgurngn (SEQ ID NO: 13), AGGAgurngn (SEQ ID NO: 14), AUGAgurngn (SEQ ID NO: 15), CAGAgurngn (SEQ ID NO: 16), CCGAgurngn (SEQ ID NO: 17), CGGAgurngn (SEQ ID NO: 18), CUGAgurngn (SEQ ID NO: 19), GAGAgurngn (SEQ ID NO: 20), GCGAgurngn (SEQ ID NO: 21), GGGAgurngn (SEQ ID NO: 22), GUGAgurngn (SEQ ID NO: 23), UAGAgurngn (SEQ ID NO: 24), UCGAgurngn (SEQ ID NO: 25), UGGAgurngn (SEQ ID NO: 52) and UUGAgurngn (SEQ ID NO: 53) at the RNA level, wherein r is A or G (i.e., a purine nucleotide adenine or guanine) and n or N is any nucleotide, by which the intronic REMS, in the presence of a compound described herein, functions as an intronic 5' splice site, causing the NNGA nucleotides of the REMS and the intronic nucleotides between the intronic 3' splice site down to and including the NNGA nucleotides to be spliced into the mature RNA as an intronic exon to provide a non-wild-type, nonfunctional mRNA. In another specific aspect, the intronic REMS is upstream of an intronic branch point and a functional intronic 3' splice site, wherein the intronic REMS comprises a nucleotide sequence selected from the group consisting of ANGAgurngn (SEQ ID NO: 4), CNGAgurngn (SEQ ID NO: 5), GNGAgurngn (SEQ ID NO: 6), UNGAgurngn (SEQ ID NO: 7), NAGAgurngn (SEQ ID NO: 8), NCGAgurngn (SEQ ID NO: 9), NGGAgurngn (SEQ ID NO: 10), NUGAgurngn (SEQ ID NO: 11), AAGAgurngn (SEQ ID NO: 12), ACGAgurngn (SEQ ID NO: 13), AGGAgurngn (SEQ ID NO: 14), AUGAgurngn (SEQ ID NO: 15), CAGAgurngn (SEQ ID NO: 16), CCGAgurngn (SEQ ID NO: 17), CGGAgurngn (SEQ ID NO: 18), CUGAgurngn (SEQ ID NO: 19), GAGAgurngn (SEQ ID NO: 20), GCGAgurngn (SEQ ID NO: 21), GGGAgurngn (SEQ ID NO: 22), GUGAgurngn (SEQ ID NO: 23), UAGAgurngn (SEQ ID NO: 24), UCGAgurngn (SEQ ID NO: 25), UGGAgurngn (SEQ ID NO: 52) and UUGAgurngn (SEQ ID NO: 53) at the RNA level, wherein r is A or G (i.e., a purine nucleotide adenine or guanine) and n or N is any nucleotide, by which the intronic REMS, in the presence of a compound described herein, functions as an intronic 5' splice site, causing the NNGA nucleotides of the REMS and the intronic nucleotides between the intronic 3' splice site down to and including the NNGA nucleotides to be spliced into the mature RNA as an intronic exon to provide a non-wild-type, nonfunctional mRNA. In a preferred aspect, the REMS has a nucleotide sequence selected from the group consisting of ANGAguragu (SEQ ID NO: 28), CNGAguragu (SEQ ID NO: 29), GNGAguragu (SEQ ID NO: 30), UNGAguragu (SEQ ID NO: 31), NAGAguragu (SEQ ID NO: 32), NCGAguragu (SEQ ID NO: 33), NGGAguragu (SEQ ID NO: 34), NUGAguragu (SEQ ID NO: 35), AAGAguragu (SEQ ID NO: 36), ACGAguragu (SEQ ID NO: 37), AGGAguragu (SEQ ID NO: 38), AUGAguragu (SEQ ID NO: 39), CAGAguragu (SEQ ID NO: 40), CCGAguragu (SEQ ID NO: 41), CGGAguragu (SEQ ID NO: 42), CUGAguragu (SEQ ID NO: 43), GAGAguragu (SEQ ID NO: 44), GCGAguragu (SEQ ID NO: 45), GGGAguragu (SEQ ID NO: 46), GUGAguragu (SEQ ID NO: 47), UAGAguragu (SEQ ID NO: 48), UCGAguragu (SEQ ID NO: 49), UGGAguragu (SEQ ID NO: 489) and UUGAguragu (SEQ ID NO: 508) at the RNA level, wherein r is A or G (i.e., a purine nucleotide adenine or guanine) and N is any nucleotide. In one or more aspects provided herein, N is adenine or guanine.

In the context of DNA, in a specific aspect, the nucleotide sequence encoding an intronic REMS has the sequence Gagtrngn, wherein r is A or G (i.e., a purine nucleotide adenine or guanine) and n is any nucleotide. In another specific aspect, in the context of DNA, the nucleotide sequence encoding an intronic REMS has the sequence Gagtragt, wherein r is adenine or guanine. In a specific aspect, in the context of DNA, the nucleotide sequence encoding an intronic REMS has the sequence NNGAgtrngn (SEQ ID NO: 1808), wherein r is A or G (i.e., a purine nucleotide adenine or guanine) and n or N is any nucleotide. In another specific aspect, in the context of DNA, the nucleotide sequence encoding an intronic REMS has the sequence NNGAgtragt (SEQ ID NO: 3634), wherein r is adenine or guanine and N is any nucleotide. In a specific aspect, in the context of DNA, the nucleotide sequence encoding an intronic REMS comprises a sequence selected from the group consisting of ANGAgtrngn (SEQ ID NO: 1809), CNGAgtrngn (SEQ ID NO: 1810), GNGAgtrngn (SEQ ID NO: 1811), TNGAgtrngn (SEQ ID NO: 1812), NAGAgtrngn (SEQ ID NO: 1813), NCGAgtrngn (SEQ ID NO: 1814), NGGAgtrngn (SEQ ID NO: 1815), NTGAgtrngn (SEQ ID NO: 1816), AAGAgtrngn (SEQ ID NO: 1817), ACGAgtrngn (SEQ ID NO: 1818), AGGAgtrngn (SEQ ID NO: 1819), ATGAgtrngn (SEQ ID NO: 1820), CAGAgtrngn (SEQ ID NO: 1821), CCGAgtrngn (SEQ ID NO: 1822), CGGAgtrngn (SEQ ID NO: 1823), CTGAgtrngn (SEQ ID NO: 1824), GAGAgtrngn (SEQ ID NO: 1825), GCGAgtrngn (SEQ ID NO: 1826), GGGAgtrngn (SEQ ID NO: 1827), GTGAgtrngn (SEQ ID NO: 1828), TAGAgtrngn (SEQ ID NO: 1829), TCGAgtrngn (SEQ ID NO: 1830), TGGAgtrngn (SEQ ID NO: 1831) and TTGAgtrngn (SEQ ID NO: 1832), wherein r is A or G (i.e., a purine nucleotide adenine or guanine) and n or N is any nucleotide. In a preferred aspect, in the context of DNA, the nucleotide sequence encoding the intronic REMS comprises a sequence selected from the group consisting of ANGAgtragt (SEQ ID NO: 1833), CNGAgtragt (SEQ ID NO: 1834), GNGAgtragt (SEQ ID NO: 1835), TNGAgtragt (SEQ ID NO: 1836), NAGAgtragt (SEQ ID NO: 1837), NCGAgtragt (SEQ ID NO: 1838), NGGAgtragt (SEQ ID NO: 1839), NTGAgtragt (SEQ ID NO: 1840), AAGAgtragt (SEQ ID NO: 1841), ACGAgtragt (SEQ ID NO: 1842), AGGAgtragt (SEQ ID NO: 1843), ATGAgtragt (SEQ ID NO: 1844), CAGAgtragt (SEQ ID NO: 1845), CCGAgtragt (SEQ ID NO: 1846), CGGAgtragt (SEQ ID NO: 1847), CTGAgtragt (SEQ ID NO: 1848), GAGAgtragt (SEQ ID NO: 1849), GCGAgtragt (SEQ ID NO: 1850), GGGAgtragt (SEQ ID NO: 1851), GTGAgtragt (SEQ ID NO: 1852), TAGAgtragt (SEQ ID NO: 1853), TCGAgtragt (SEQ ID NO: 1854), TGGAgtragt (SEQ ID NO: 1855) and TTGAgtragt (SEQ ID NO: 1856), wherein r is adenine or guanine and N is any nucleotide. In one or more aspects provided herein, N is adenine or guanine.

An intronic REMS can be part of an endogenous RNA or can be introduced into an RNA sequence that does not naturally contain the intronic REMS sequence (in which case, the introduced intronic REMS is a non-endogenous intronic REMS, i.e., an intronic REMS not naturally present in the corresponding RNA. A nucleotide sequence encoding an intronic REMS can also be part of an endogenous DNA sequence, or a nucleotide sequence encoding the intronic REMS can be introduced into a DNA sequence that does not naturally contain the nucleotide sequence encoding an intronic REMS.

In a specific aspect, the REMS is located in an intron and is upstream of a branch point and a functional 3' splice site which, in the presence of a small molecule splicing modifier, enables the REMS to function as a 5' splice site. Without being bound by any theory or mechanism, the small molecule compounds described herein have been shown to increase the affinity of the interaction between the U1 snRNP, as well as other components of the pre-mRNA splicing machinery, and the nucleotides NNGA of the REMS whereby, in the presence of the compound, the intronic REMS functions as a U1 snRNP binding site, causing the intronic nucleotides to be spliced as an intronic exon.

Compound Use

In one aspect provided herein are compounds of Formula (I) for use in the methods described herein:

$$\underset{N-N}{A-\!\!\!\underset{\|}{\overset{W}{\diagdown}}\!\!\!-X\diagdown B} \quad (I)$$

or a form thereof, wherein

W is CH=CH or S;

X is $CH_2$, $CH(C_{1-4}alkyl)$, $C(C_{1-4}alkyl)_2$, CH=CH, O, $NR_5$, or a bond;

A is aryl, heteroaryl, heterocyclyl, or $C_{9-10}$cycloalkyl, wherein aryl is selected from phenyl and naphthyl, each optionally substituted with 1, 2, 3, or 4 substituents each selected from $R_1$, wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from $R_1$, wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from $R_2$, and wherein $C_{9-10}$cycloalkyl is a saturated or partially unsaturated bicyclic ring system optionally substituted with 1, 2, 3, 4, or 5 substituents each selected from $R_2$;

B is heterocyclyl, wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from $R_4$;

$R_1$ is halogen, hydroxyl, cyano, $C_{1-4}$alkyl, halo-$C_{1-4}$alkyl, amino, $C_{1-4}$alkyl-amino, $(C_{1-4}alkyl)_2$-amino, amino-$C_{1-4}$alkyl, $C_{1-4}$alkyl-amino-$C_{1-4}$alkyl, $(C_{1-4}alkyl)_2$-amino-$C_{1-4}$alkyl, amino-carbonyl, $C_{1-4}$alkyl-amino-carbonyl, $(C_{1-4}alkyl)_2$-amino-carbonyl, $C_{1-4}$alkyl-amino-carbonyl-$C_{1-4}$alkyl, $(C_{1-4}alkyl)_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}alkyl)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, heterocyclyl-$C_{1-4}$alkoxy, phenyl, or phenyl-$C_{1-4}$alkoxy, wherein heteroaryl is a saturated monocyclic or bicyclic ring system having 1, 2, or 3 heteroatom ring members selected from N, O, and S, wherein heterocyclyl is a saturated or partially unsaturated monocyclic or bicyclic ring system having 1, 2, or 3 heteroatom ring members selected from N, O, and S, and wherein each instance of phenyl, heteroaryl or heterocyclyl is optionally substituted with 1, or 2 substituents each selected from $R_3$;

$R_2$ is halogen, hydroxyl, cyano, oxo, hydroxyl-imino, $C_{1-4}$alkyl, halo-$C_{1-4}$alkyl, amino, $C_{1-4}$alkyl-amino, $(C_{1-4}alkyl)_2$-amino, amino-$C_{1-4}$alkyl, $C_{1-4}$alkyl-amino-$C_{1-4}$alkyl, $(C_{1-4}alkyl)_2$-amino-$C_{1-4}$alkyl, amino-carbonyl, hydroxyl-$C_{1-4}$alkyl, $C_{1-4}$alkoxy, $C_{1-4}$alkoxy-carbonyl, $C_{2-4}$alkenyl, $C_{3-7}$cycloalkyl, or heterocyclyl-$C_{1-4}$alkyl, wherein heterocyclyl is a saturated or partially unsaturated monocyclic or bicyclic ring system having 1, 2, or 3 heteroatom ring members selected from N, O, and S, and wherein each instance of heterocyclyl is optionally substituted with 1, or 2 substituents each selected from $R_3$;

$R_3$ is halogen, hydroxyl, nitro, oxo, hydroxyl-imino, $C_{1-4}$alkyl, halo-$C_{1-4}$alkyl, amino, $C_{1-4}$alkyl-amino, $(C_{1-4}alkyl)_2$-amino, amino-$C_{1-4}$alkyl, $C_{1-4}$alkyl-amino-$C_{1-4}$alkyl, $(C_{1-4}alkyl)_2$-amino-$C_{1-4}$alkyl, amino-carbonyl, $C_{1-4}$alkyl-amino-carbonyl, $(C_{1-4}alkyl)_2$-amino-carbonyl, $C_{1-4}$alkyl-amino-carbonyl-$C_{1-4}$alkyl, $(C_{1-4}alkyl)_2$-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, $(C_{1-4}alkyl)_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, phenyl, or phenyl-$C_{1-4}$alkoxy;

$R_4$ is independently selected from halogen, $C_{1-4}$alkyl, hydroxyl-$C_{1-4}$alkyl, amino, $C_{1-4}$alkyl-amino, $(C_{1-4}alkyl)_2$-amino or hydroxyl-$C_{1-4}$alkyl-amino; and $R_5$ is hydrogen, $C_{1-4}$alkyl, or hydroxyl-$C_{1-4}$alkyl;

wherein a form of the compound is selected from the group consisting of a prodrug, salt, hydrate, solvate, clathrate, isotopologue, racemate, enantiomer, diastereomer, stereoisomer, polymorph and tautomer form thereof.

In another aspect provided herein are compounds of Formula (I) selected from a compound of Formula (Ia) and Formula (Ib) for use in the methods described herein:

$$A-\!\!\!\underset{N=N}{\diagdown}\!\!\!-X\diagdown B \quad (Ia)$$

$$\underset{N-N}{A-\!\!\!\underset{\|}{\overset{S}{\diagdown}}\!\!\!-X\diagdown B} \quad (Ib)$$

or a form thereof, wherein

X is $CH_2$, $CH(C_{1-4}alkyl)$, $C(C_{1-4}alkyl)_2$, CH=CH, O, $NR_5$, or a bond;

A is aryl, heteroaryl, heterocyclyl, or $C_{9-10}$cycloalkyl, wherein aryl is selected from phenyl and naphthyl, each optionally substituted with 1, 2, 3, or 4 substituents each selected from $R_1$, wherein heteroaryl is a saturated monocyclic, bicyclic or tricyclic ring system having 1, 2, or 3 heteroatom ring members independently selected from N, O, or S, each optionally substituted with 1, 2, 3, 4, or 5 substituents each selected from $R_1$, wherein heterocyclyl is a saturated or partially unsaturated monocyclic, bicyclic or tricyclic ring system having 1, 2, or 3 heteroatom ring members independently selected from N, O, or S, each optionally substituted with 1, 2, 3, 4, or 5 substituents each selected from $R_2$, and wherein $C_{9-10}$cycloalkyl is a saturated or partially unsaturated bicyclic ring system optionally substituted with 1, 2, 3, 4, or 5 substituents each selected from $R_2$;

B is heterocyclyl, wherein heterocyclyl is a saturated or partially unsaturated monocyclic, bicyclic or polycyclic ring system having 1, 2, or 3 heteroatom ring members independently selected from N, O, or S, each optionally substituted with 1, 2, 3, 4, or 5 substituents each selected from $R_4$, $R_1$ is halogen, hydroxyl, cyano, $C_{1-4}$alkyl, halo-$C_{1-4}$alkyl, amino, $C_{1-4}$alkyl-amino, ($C_{1-4}$alkyl)$_2$-amino, amino-$C_{1-4}$alkyl, $C_{1-4}$alkyl-amino-$C_{1-4}$alkyl, ($C_{1-4}$alkyl)$_2$-amino-$C_{1-4}$alkyl, amino-carbonyl, $C_{1-4}$alkyl-amino-carbonyl, $C_{1-4}$alkyl-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, ($C_{1-4}$alkyl)$_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, heterocyclyl-$C_{1-4}$alkoxy, phenyl, or phenyl-$C_{1-4}$alkoxy, wherein heteroaryl is a saturated monocyclic or bicyclic ring system having 1, 2, or 3 heteroatom ring members selected from N, O, and S, wherein heterocyclyl is a saturated or partially unsaturated monocyclic or bicyclic ring system having 1, 2, or 3 heteroatom ring members selected from N, O, and S, and wherein each instance of phenyl, heteroaryl or heterocyclyl is optionally substituted with 1, or 2 substituents each selected from $R_3$;

$R_2$ is halogen, hydroxyl, cyano, oxo, hydroxyl-imino, $C_{1-4}$alkyl, halo-$C_{1-4}$alkyl, amino, $C_{1-4}$alkyl-amino, ($C_{1-4}$alkyl)$_2$-amino, amino-$C_{1-4}$alkyl, amino-carbonyl, hydroxyl-$C_{1-4}$alkyl, $C_{1-4}$alkoxy, $C_{1-4}$alkoxy-carbonyl, $C_{2-4}$alkenyl, $C_{3-7}$cycloalkyl, or heterocyclyl-$C_{1-4}$alkyl;

$R_3$ is halogen, hydroxyl, nitro, oxo, hydroxyl-imino, $C_{1-4}$alkyl, amino, $C_{1-4}$alkyl-amino, ($C_{1-4}$alkyl)$_2$-amino, amino-$C_{1-4}$alkyl, $C_{1-4}$alkyl-amino-$C_{1-4}$alkyl, ($C_{1-4}$alkyl)$_2$-amino-$C_{1-4}$alkyl, amino-carbonyl, $C_{1-4}$alkyl-amino-carbonyl, $C_{1-4}$alkyl-amino-carbonyl-$C_{1-4}$alkyl, $C_{1-4}$alkyl-carbonyl-amino, $C_{1-4}$alkyl-carbonyl-amino-$C_{1-4}$alkyl, hydroxyl-$C_{1-4}$alkyl, $C_{1-4}$alkyl-carbonyl, $C_{1-4}$alkoxy, halo-$C_{1-4}$alkoxy, amino-$C_{1-4}$alkoxy, hydroxyl-$C_{1-4}$alkoxy, $C_{1-4}$alkyl-$C_{1-4}$alkoxy, $C_{1-4}$alkyl-amino-$C_{1-4}$alkoxy, ($C_{1-4}$alkyl)$_2$-amino-$C_{1-4}$alkoxy, $C_{1-4}$alkyl-carbonyl-amino-$C_{1-4}$alkoxy, $C_{1-4}$alkoxy-$C_{1-4}$alkoxy, $C_{1-4}$alkoxy-carbonyl, $C_{1-4}$alkoxy-carbonyl-amino, $C_{1-4}$alkoxy-carbonyl-amino-$C_{1-4}$alkoxy, $C_{2-4}$alkenyl, $C_{2-4}$alkenyl-amino-carbonyl, $C_{3-7}$cycloalkyl, $C_{3-7}$cycloalkyl-$C_{1-4}$alkoxy, $C_{3-7}$cycloalkenyl, heteroaryl, heteroaryl-$C_{1-4}$alkyl, heteroaryl-$C_{1-4}$alkyl-amino, heteroaryl-$C_{1-4}$alkyl-amino-carbonyl, heteroaryl-$C_{1-4}$alkyl-carbonyl-amino, heteroaryl-$C_{1-4}$alkyl-amino-carbonyl-$C_{1-4}$alkyl, heteroaryl-$C_{1-4}$alkyl-carbonyl-amino-$C_{1-4}$alkyl, heterocyclyl, heterocyclyl-$C_{1-4}$alkyl, phenyl, or phenyl-$C_{1-4}$alkoxy;

$R_4$ is independently selected from halogen, $C_{1-4}$alkyl, hydroxyl-$C_{1-4}$alkyl, amino, $C_{1-4}$alkyl-amino, ($C_{1-4}$alkyl)$_2$-amino or hydroxyl-$C_{1-4}$alkyl-amino; and $R_5$ is hydrogen, $C_{1-4}$alkyl, or hydroxyl-$C_{1-4}$alkyl;

wherein a form of the compound is selected from the group consisting of a prodrug, salt, hydrate, solvate, clathrate, isotopologue, racemate, enantiomer, diastereomer, stereoisomer, polymorph and tautomer form thereof.

In another aspect provided herein are compounds of Formula (I) selected from a compound of Formula (Ia) and Formula (Ib) for use in the methods described herein:

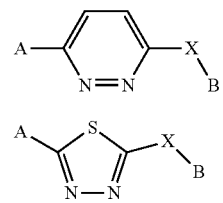

(Ia)

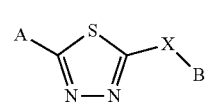

(Ib)

or a form thereof, wherein

X is O, NH, N(CH$_3$) or a bond;

A is aryl, heteroaryl or heterocyclyl, wherein aryl is selected from the group consisting of

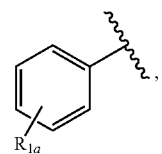

a1

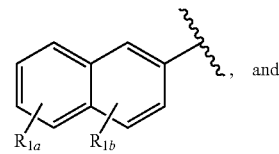

a2

, and

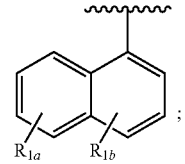

a3

;

wherein heteroaryl is selected from the group consisting of

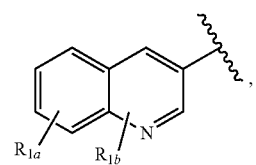

a4

,

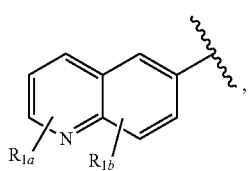 a5,
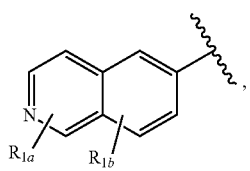 a6,
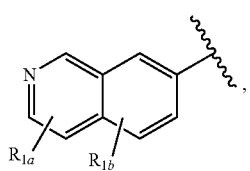 a7,
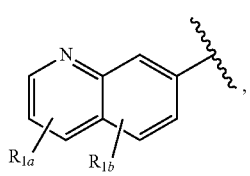 a8,
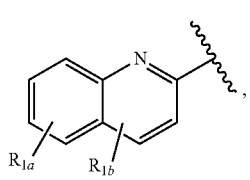 a9,
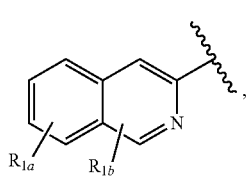 a10,
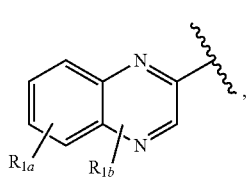 a11,
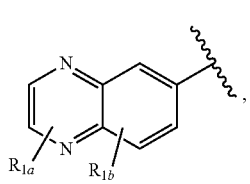 a12,
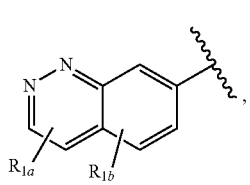 a13,
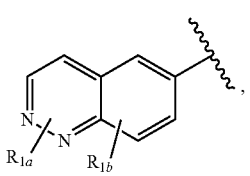 a14,
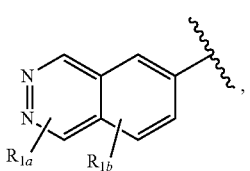 a15,
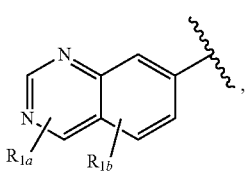 a16,
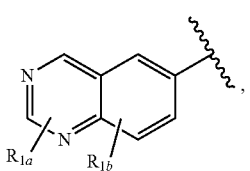 a17,
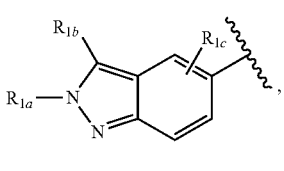 a18,
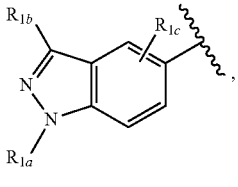 a19,
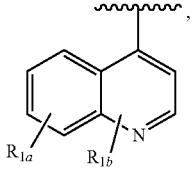 a20,
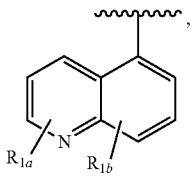 a21,
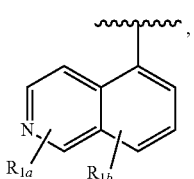 a22, -continued
a23 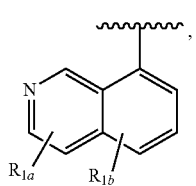
a24 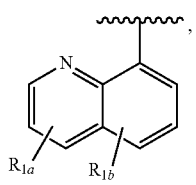
a25 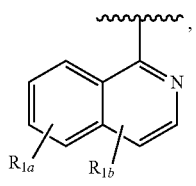
a26 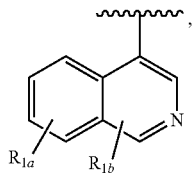
a27 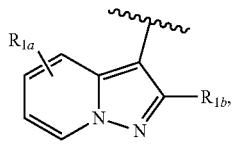
a28 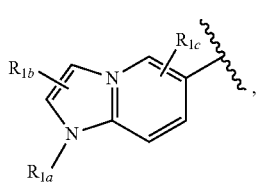
a29 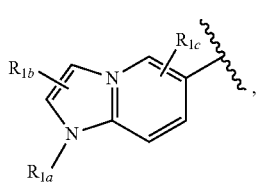
a30 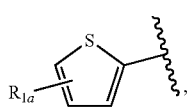
a31 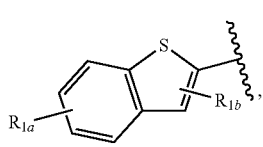
a32 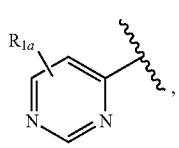
-continued
a33 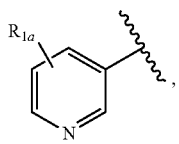
a34 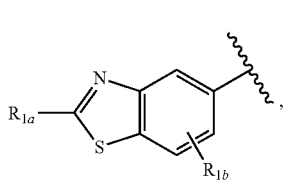
a35 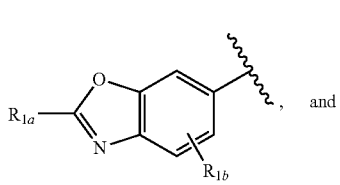, and
a36 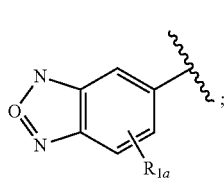;
wherein heterocyclyl is selected from the group consisting of
a37 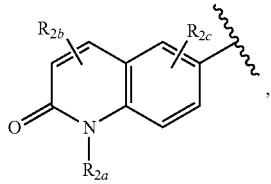
a38 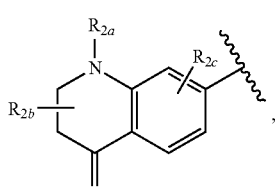
a39 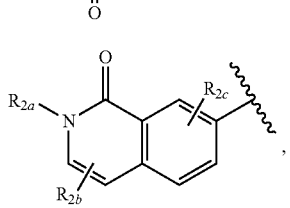
a40 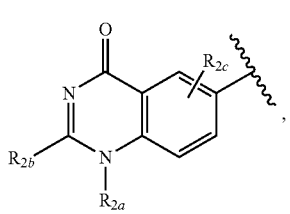

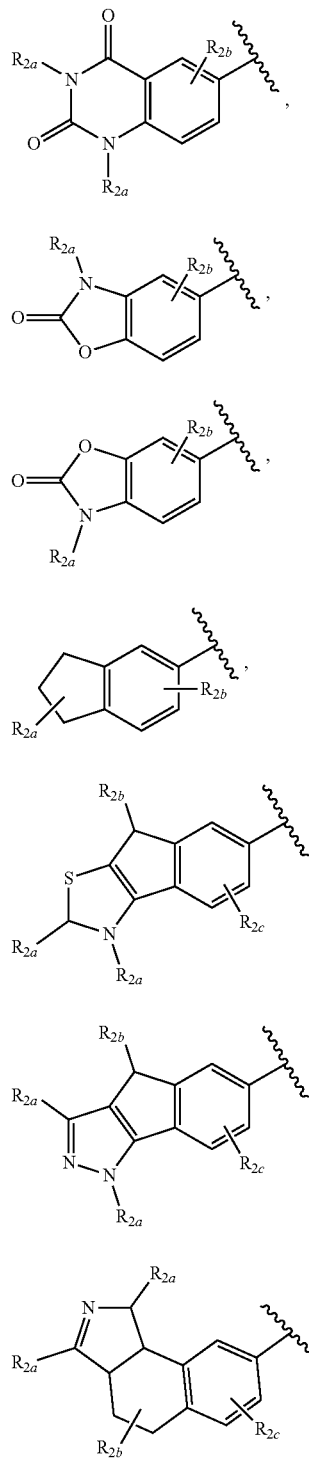
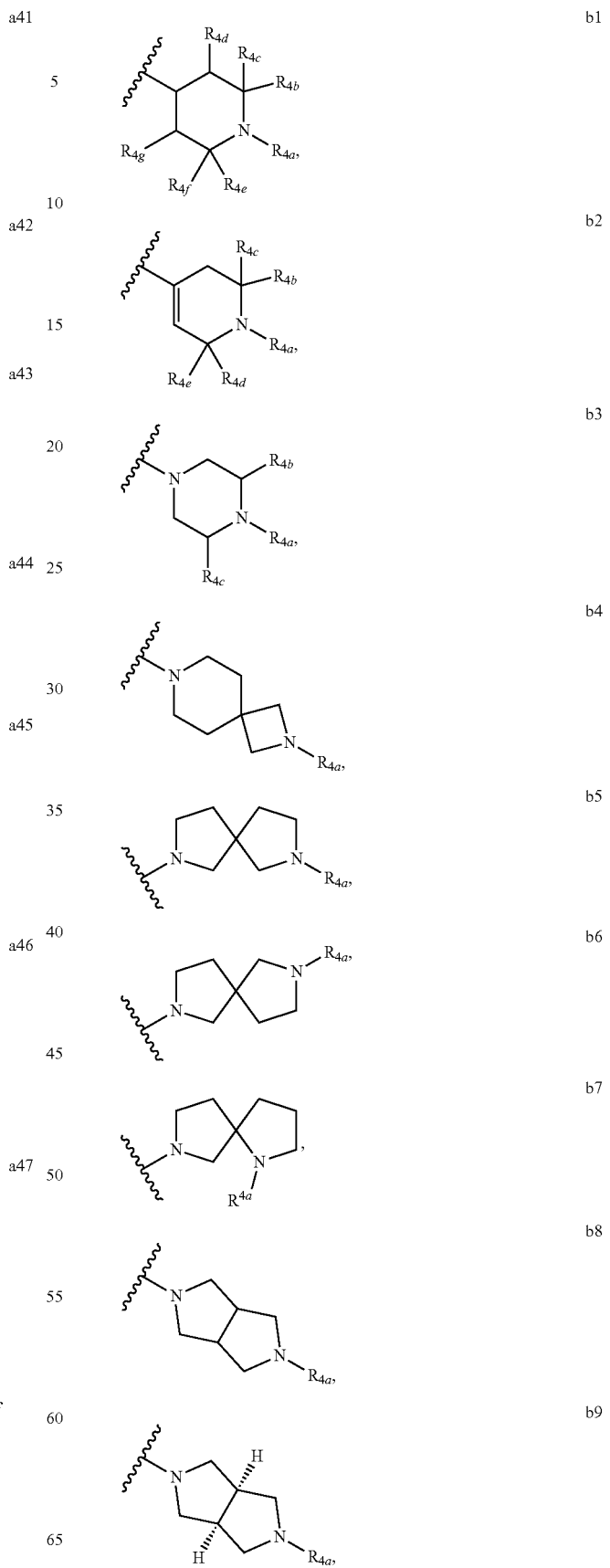
B is heterocyclyl selected from the group consisting of

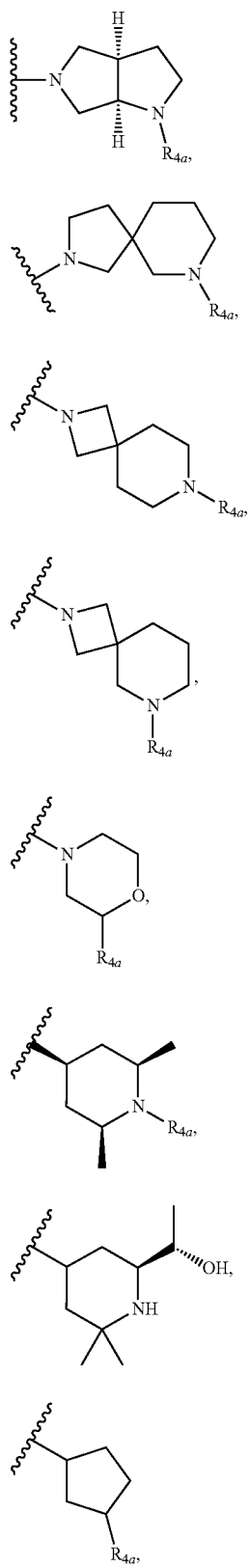
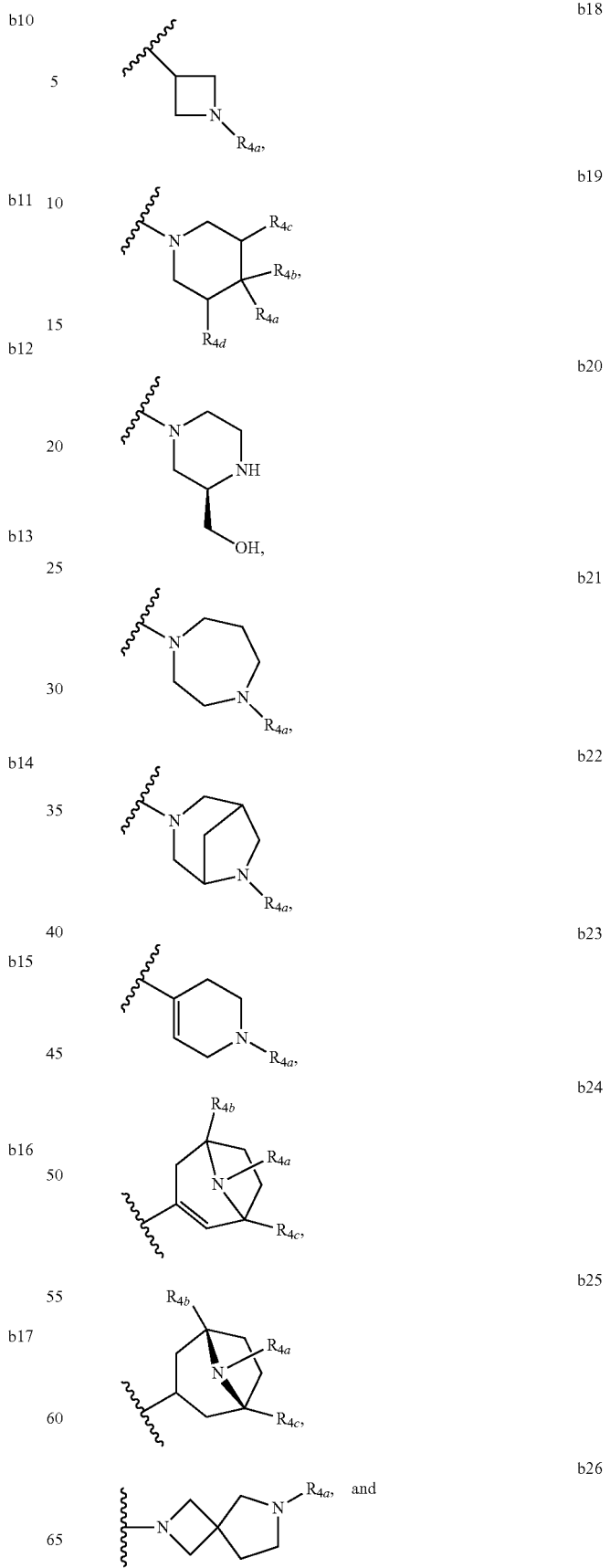

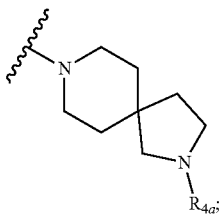

R$_{1a}$, R$_{1b}$ and R$_{1c}$ are each, where allowed by available valences, one or more substituents each selected from halogen, hydroxyl, cyano, C$_{1-4}$alkyl, halo-C$_{1-4}$alkyl, amino, C$_{1-4}$alkyl-amino, (C$_{1-4}$alkyl)$_2$-amino, amino-C$_{1-4}$alkyl, C$_{1-4}$alkyl-amino-C$_{1-4}$alkyl, (C$_{1-4}$alkyl)$_2$-amino-C$_{1-4}$alkyl, amino-carbonyl, C$_{1-4}$alkyl-amino-carbonyl, (C$_{1-4}$alkyl)$_2$-amino-carbonyl, C$_{1-4}$alkyl-amino-carbonyl-C$_{1-4}$alkyl, (C$_{1-4}$alkyl)$_2$-amino-carbonyl-C$_{1-4}$alkyl, C$_{1-4}$alkyl-carbonyl-amino, C$_{1-4}$alkyl-carbonyl-amino-C$_{1-4}$alkyl, hydroxyl-C$_{1-4}$alkyl, C$_{1-4}$alkyl-carbonyl, C$_{1-4}$alkoxy, halo-C$_{1-4}$alkoxy, amino-C$_{1-4}$alkoxy, hydroxyl-C$_{1-4}$alkoxy, C$_{1-4}$alkyl-C$_{1-4}$alkoxy, C$_{1-4}$alkyl-amino-C$_{1-4}$alkoxy, (C$_{1-4}$alkyl)$_2$-amino-C$_{1-4}$alkoxy, C$_{1-4}$alkyl-carbonyl-amino-C$_{1-4}$alkoxy, C$_{1-4}$alkoxy-C$_{1-4}$alkoxy, C$_{1-4}$alkoxy-carbonyl, C$_{1-4}$alkoxy-carbonyl-amino, C$_{1-4}$alkoxy-carbonyl-amino-C$_{1-4}$alkoxy, C$_{2-4}$alkenyl, C$_{2-4}$alkenyl-amino-carbonyl, C$_{3-7}$cycloalkyl, C$_{3-7}$cycloalkyl-C$_{1-4}$alkoxy, C$_{3-7}$cycloalkenyl, heteroaryl, heteroaryl-C$_{1-4}$alkyl, heteroaryl-C$_{1-4}$alkyl-amino, heteroaryl-C$_{1-4}$alkyl-amino-carbonyl, heteroaryl-C$_{1-4}$alkyl-carbonyl-amino, heteroaryl-C$_{1-4}$alkyl-amino-carbonyl-C$_{1-4}$alkyl, heteroaryl-C$_{1-4}$alkyl-carbonyl-amino-C$_{1-4}$alkyl, heterocyclyl, heterocyclyl-C$_{1-4}$alkyl, heterocyclyl-C$_{1-4}$alkoxy, phenyl, or phenyl-C$_{1-4}$alkoxy, wherein heteroaryl is a saturated monocyclic or bicyclic ring system having 1, 2, or 3 heteroatom ring members selected from N, O, and S, wherein heterocyclyl is a saturated or partially unsaturated monocyclic or bicyclic ring system having 1, 2, or 3 heteroatom ring members selected from N, O, and S, and wherein each instance of phenyl, heteroaryl or heterocyclyl is optionally substituted with 1, or 2 substituents each selected from R$_3$;

R$_{2a}$, R$_{2b}$ and R$_{2c}$ are each, where allowed by available valences, one or more substituents each selected from halogen, hydroxyl, cyano, oxo, hydroxyl-imino, C$_{1-4}$alkyl, halo-C$_{1-4}$alkyl, amino, C$_{1-4}$alkyl-amino, (C$_{1-4}$alkyl)$_2$-amino, amino-C$_{1-4}$alkyl, C$_{1-4}$alkyl-amino-C$_{1-4}$alkyl, (C$_{1-4}$alkyl)$_2$-amino-C$_{1-4}$alkyl, amino-carbonyl, hydroxyl-C$_{1-4}$alkyl, C$_{1-4}$alkoxy, C$_{1-4}$alkoxy-carbonyl, C$_{2-4}$alkenyl, C$_{3-7}$cycloalkyl, or heterocyclyl-C$_{1-4}$alkyl, wherein heterocyclyl is a saturated or partially unsaturated monocyclic or bicyclic ring system having 1, 2, or 3 heteroatom ring members selected from N, O, and S, and wherein each instance of heterocyclyl is optionally substituted with 1, or 2 substituents each selected from R$_3$;

R$_3$ is halogen, hydroxyl, nitro, oxo, hydroxyl-imino, C$_{1-4}$alkyl, amino, C$_{1-4}$alkyl-amino, (C$_{1-4}$alkyl)$_2$-amino, amino-C$_{1-4}$alkyl, C$_{1-4}$alkyl-amino-C$_{1-4}$alkyl, (C$_{1-4}$alkyl)$_2$-amino-C$_{1-4}$alkyl, amino-carbonyl, C$_{1-4}$alkyl-amino-carbonyl, (C$_{1-4}$alkyl)$_2$-amino-carbonyl, C$_{1-4}$alkyl-amino-carbonyl-C$_{1-4}$alkyl, (C$_{1-4}$alkyl)$_2$-amino-carbonyl-C$_{1-4}$alkyl, C$_{1-4}$alkyl-carbonyl-amino, C$_{1-4}$alkyl-carbonyl-amino-C$_{1-4}$alkyl, hydroxyl-C$_{1-4}$alkyl, C$_{1-4}$alkyl-carbonyl, C$_{1-4}$alkoxy, halo-C$_{1-4}$alkoxy, amino-C$_{1-4}$alkoxy, hydroxyl-C$_{1-4}$alkoxy, C$_{1-4}$alkyl-C$_{1-4}$alkoxy, C$_{1-4}$alkyl-amino-C$_{1-4}$alkoxy, (C$_{1-4}$alkyl)$_2$-amino-C$_{1-4}$alkoxy, C$_{1-4}$alkyl-carbonyl-amino-C$_{1-4}$alkoxy, C$_{1-4}$alkoxy-C$_{1-4}$alkoxy, C$_{1-4}$alkoxy-carbonyl, C$_{1-4}$alkoxy-carbonyl-amino, C$_{1-4}$alkoxy-carbonyl-amino-C$_{1-4}$alkoxy, C$_{2-4}$alkenyl, C$_{2-4}$alkenyl-amino-carbonyl, C$_{3-7}$cycloalkyl, C$_{3-7}$cycloalkyl-C$_{1-4}$alkoxy, C$_{3-7}$cycloalkenyl, heteroaryl, heteroaryl-C$_{1-4}$alkyl, heteroaryl-C$_{1-4}$alkyl-amino, heteroaryl-C$_{1-4}$alkyl-amino-carbonyl, heteroaryl-C$_{1-4}$alkyl-carbonyl-amino, heteroaryl-C$_{1-4}$alkyl-amino-carbonyl-C$_{1-4}$alkyl, heteroaryl-C$_{1-4}$alkyl-carbonyl-amino-C$_{1-4}$alkyl, heterocyclyl, heterocyclyl-C$_{1-4}$alkyl, phenyl, or phenyl-C$_{1-4}$alkoxy; and R$_{4a}$, R$_{4b}$, R$_{4c}$, R$_{4d}$, R$_{4e}$, R$_{4f}$ and R$_{4g}$ are independently selected from halogen, C$_{1-4}$alkyl, hydroxyl-C$_{1-4}$alkyl, amino, C$_{1-4}$alkyl-amino, (C$_{1-4}$alkyl)$_2$-amino or hydroxyl-C$_{1-4}$alkyl-amino;

wherein a form of the compound is selected from the group consisting of a prodrug, salt, hydrate, solvate, clathrate, isotopologue, racemate, enantiomer, diastereomer, stereoisomer, polymorph and tautomer form thereof.

In another aspect provided herein are compounds of Formula (I) for use in the methods described herein, wherein the compound of Formula (I) is selected from a compound of Formula (Ia11), Formula (Ia15), Formula (Ia18) or Formula (Ib1):

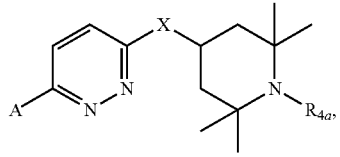
(Ia11)

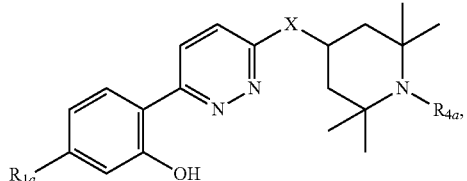
(Ia15)

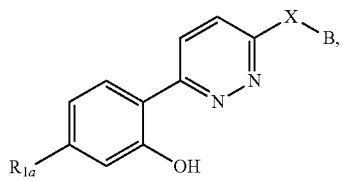
(Ia18)

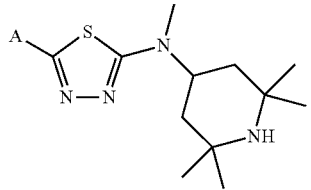
(Ib1)

or a form thereof, wherein (when present),

X is selected from O, NR$_5$, or a bond;

A is selected from phenyl, thiophenyl, indazolyl, pyridinyl, pyrimidinyl or phenoxy, wherein phenyl and phenoxy are each optionally substituted with 1, 2 or 3 substituents each selected from R$_{1a}$, wherein thiophenyl, indazolyl, pyridinyl, pyrimidinyl are each optionally substituted with 1 or 2 substituents each selected from R$_{1a}$, B is selected from 1H-pyrazolyl, piperidinyl, 1,2,3,6-tetrahydropyridinyl, (1R,5S)-8-azabicyclo[3.2.1]octyl, 8-azabicyclo[3.2.1]oct-2-enyl, 2,6-diazaspiro[3.4]octyl or 2,7-diazaspiro[3.5]nonyl, each optionally substituted with 1 or 2 substituents each selected from $R_{4a}$;

$R_{1a}$ is selected from halogen, hydroxyl, $C_{1-4}$alkyl, halo-$C_{1-4}$alkyl, amino, $C_{1-4}$alkoxy, or heteroaryl, wherein heteroaryl is a saturated monocyclic or bicyclic ring system having 1, 2, or 3 heteroatom ring members selected from N, O, and S optionally substituted with 1 or 2 substituents each selected from $R_{3a}$;

$R_{3a}$ is selected from nitro or $C_{1-4}$alkyl; and, $R_{4a}$ is $C_{1-4}$alkyl;

$R_{5a}$ is hydrogen, $C_{1-4}$alkyl, or hydroxyl-$C_{1-4}$alkyl;

wherein a form of the compound is selected from the group consisting of a prodrug, salt, hydrate, solvate, clathrate, isotopologue, racemate, enantiomer, diastereomer, stereoisomer, polymorph and tautomer form thereof.

Another aspect of the present description relates to a compound of Formula (I) selected from a compound of Formula (Ia11), Formula (Ia15), Formula (Ia18) or Formula (Ib1):

or a form thereof, wherein (when present), $R_{1a}$ is selected from fluoro, chloro, hydroxyl, methyl, difluoromethyl, amino, methoxy or 1H-pyrazolyl or 1H-imidazol-1-yl, wherein 1H-pyrazolyl is optionally substituted with 1 or 2 substituents each selected from $R_{3a}$;

$R_{3a}$ is selected from nitro or methyl or amino; and, $R_{4a}$ is methyl or ethyl;

$R_{5a}$ is hydrogen or methyl;

wherein a form of the compound is selected from the group consisting of a prodrug, salt, hydrate, solvate, clathrate, isotopologue, racemate, enantiomer, diastereomer, stereoisomer, polymorph and tautomer form thereof.

In another aspect provided herein are compounds of Formula (Ia) or a form thereof for use in the methods described herein, wherein the compound is selected from a compound of Formula (Ia1) or a form thereof, wherein substituents $R_{1a}$, $R_{1b}$, and X, when present, are indicated in the table below with multiple substituents separated by a comma; and, "- -" indicates that one or more $R_{1a}$, $R_{1b}$, and X substituents are not present:

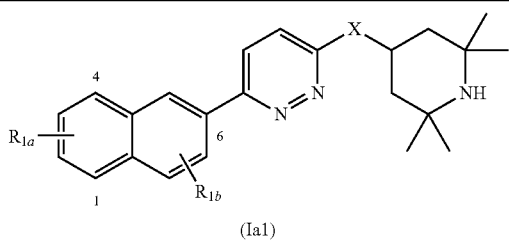

(Ia1)

| Cpd | $R_{1a}$ | $R_{1b}$ | X |
|---|---|---|---|
| 1 | — | — | NH |
| 8 | 2-OH | — | N(CH$_3$) |
| 40 | 1-CH$_2$CH=CH$_2$, 2-OH | — | N(CH$_3$) |
| 106 | 1-Br, 2-OH | 7-OH | N(CH$_3$) |
| 107 | 1-Cl, 2-OH | 7-OH | N(CH$_3$) |

In another aspect provided herein are compounds of Formula (Ia) or a form thereof for use in the methods described herein, wherein the compound is selected from a compound of Formula (Ia2) or a form thereof, wherein substituents $R_{1a}$, $R_{1b}$, and $R_{4a}$, when present, are indicated in the table below with multiple substituents separated by a comma; and, "- -" indicates that one or more $R_{1a}$, $R_{1b}$, and $R_{4a}$ substituents are not present:

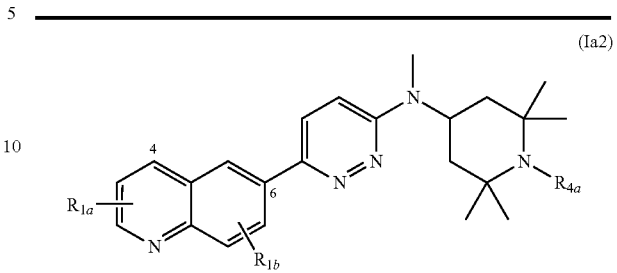

(Ia2)

| Cpd | $R_{1a}$ | $R_{1b}$ | $R_{4a}$ |
|---|---|---|---|
| 13 | — | — | H |
| 207 | — | 7-OH | H |
| 208 | — | 7-OH | CH$_3$ |
| 210 | 2-CH$_3$ | 7-OH | H |
| 222 | 3-Cl | 7-OH | H |
| 223 | 3-Br | 7-OH | H |
| 224 | 3-CN | 7-OH | H |
| 225 | 3-(1-CH$_3$-1H-imidazol-4-yl) | 7-OH | H |
| 226 | 3-(1H-imidazol-1-yl) | 7-OH | H |
| 227 | 3-OH | 7-OH | H |
| 228 | 3-CH$_2$CH$_3$ | 7-OH | H |
| 229 | 3-CH(CH$_3$)$_2$ | 7-OH | H |
| 232 | 2-CH$_3$, 4-OCH$_3$ | 7-OH | H |
| 233 | 2-CH$_3$, 4-(pyrrolidin-1-yl) | 7-OH | H |
| 234 | 2-CH$_3$, 4-(morpholin-4-yl) | 7-OH | H |
| 235 | 2-CH$_3$, 4-N(CH$_3$)$_2$ | 7-OH | H |
| 236 | 2-CH$_3$, 4-OCH$_2$CH$_3$ | 7-OH | H |
| 237 | 2-CH$_3$, 4-(1-CH$_3$-1H-pyrazol-4-yl) | 7-OH | H |
| 240 | 3-(tetrahydro-2H-pyran-4-yl) | 7-OH | H |
| 249 | 4-OCH$_3$ | 7-OH | H |
| 250 | 2-CH$_3$, 4-(azetidin-1-yl) | 7-OH | H |
| 251 | 2-CH$_3$, 4-CN | 7-OH | H |
| 252 | 2-CH$_3$, 4-cyclopropyl | 7-OH | H |
| 253 | 2-CH$_3$, 4-(3,6-dihydro-2H-pyran-4-yl) | 7-OH | H |
| 254 | 2-CH$_3$, 4-(tetrahydro-2H-pyran-4-yl) | 7-OH | H |
| 255 | 2-CH$_3$, 4-(oxetan-3-yl) | 7-OH | H |
| 256 | 4-N(CH$_3$)$_2$ | 7-OH | H |
| 262 | 2-CN | 7-OH | H |
| 265 | 2-C(O)NH$_2$ | 7-OH | H |
| 293 | 3-Cl | 7-OH | H |
| 294 | 3-CH(CH$_3$)$_2$ | 7-OH | H |
| 296 | 2-CH$_3$, 4-Cl | 7-OH | H |

In another aspect provided herein are compounds of Formula (Ia) or a form thereof for use in the methods described herein, wherein the compound is selected from a compound of Formula (Ia3) or a form thereof, wherein substituents $R_{1a}$, $R_{1b}$ and X, when present, are indicated in the table below with multiple substituents separated by a comma; and, "- -" indicates that one or more $R_{1a}$, $R_{1b}$ and X substituents are not present:

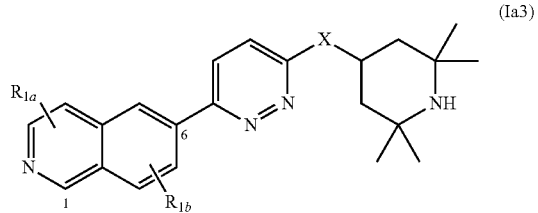

(Ia3)

| Cpd | $R_{1a}$ | $R_{1b}$ | X |
|---|---|---|---|
| 11 | — | — | O |
| 15 | — | — | $N(CH_3)$ |
| 218 | — | 7-OH | $N(CH_3)$ |
| 261 | 1-CN | 7-OH | $N(CH_3)$ |
| 272 | 1-$CH_3$ | 7-OH | $N(CH_3)$ |
| 275 | 1-CN, 3-$CH_3$ | 7-OH | $N(CH_3)$ |
| 292 | 3-($OCH_2$-phenyl) | — | $N(CH_3)$ |

In another aspect provided herein are compounds of Formula (Ia) or a form thereof for use in the methods described herein, wherein the compound is selected from a compound of Formula (Ia4) or a form thereof, wherein substituents X, $R_{1a}$, $R_{1b}$ and $R_{4a}$, when present, are indicated in the table below; and, "- -" indicates that one or more X, $R_{1a}$, $R_{1b}$ and $R_{4a}$ substituents are not present:

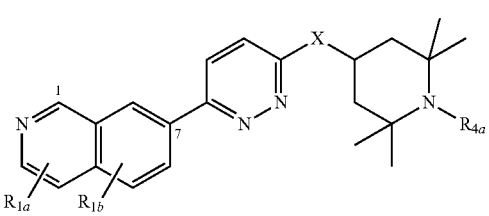

(Ia4)

| Cpd | $R_{1a}$ | $R_{1b}$ | X | $R_{4a}$ |
|---|---|---|---|---|
| 10 | — | — | O | H |
| 14 | — | — | $N(CH_3)$ | H |
| 159 | 1-($OCH_2$-phenyl) | — | $N(CH_3)$ | H |
| 211 | — | 6-OH | $N(CH_3)$ | $CH_3$ |
| 212 | — | 6-OH | $N(CH_3)$ | H |
| 213 | — | 6-OH | O | H |
| 215 | 1-cyclopropyl | 6-OH | $N(CH_3)$ | H |
| 216 | 1-OH | 6-OH | $N(CH_3)$ | H |
| 217 | 1-CN | 6-OH | $N(CH_3)$ | H |
| 264 | 1-C(O)$NH_2$ | 6-OH | $N(CH_3)$ | H |
| 273 | 1-$CH_3$ | 6-OH | $N(CH_3)$ | H |
| 274 | 1,3-$(CH_3)_2$ | 6-OH | $N(CH_3)$ | H |
| 276 | 1-$NH_2$ | 6-OH | $N(CH_3)$ | H |
| 283 | 1-$OCH_2CH_3$ | 6-OH | $N(CH_3)$ | H |
| 284 | 1-OH | 6-OH | O | H |
| 285 | 3-phenyl | 6-OH | $N(CH_3)$ | H |
| 286 | 3-$CH_3$ | 6-OH | $N(CH_3)$ | H |
| 287 | 3-cyclopropyl | 6-OH | $N(CH_3)$ | H |
| 288 | 3-$CH(CH_3)_2$ | 6-OH | $N(CH_3)$ | H |
| 289 | 3-$(CH_2)_2CH_3$ | 6-OH | $N(CH_3)$ | H |
| 290 | 3-$CH(CH_3)_2$ | 6-OH | O | H |

In another aspect provided herein are compounds of Formula (Ia) or a form thereof for use in the methods described herein, wherein the compound is selected from a compound of Formula (Ia5) or a form thereof, wherein substituents $R_{1a}$ and $R_{1b}$, when present, are indicated in the table below with multiple substituents separated by a comma; and, "- -" indicates that one or more $R_{1a}$ and $R_{1b}$ substituents are not present:

(Ia5)

| Cpd | $R_{1a}$ | $R_{1b}$ |
|---|---|---|
| 12 | — | — |
| 220 | — | 6-OH |
| 221 | 2-$CH_3$ | 6-OH |
| 238 | 4-$OCH_3$ | 6-OH |
| 241 | 3-Cl | 6-OH |
| 242 | 3-Br | 6-OH |
| 243 | 3-$CH_3$ | 6-OH |
| 244 | 3-$CH_3$ | 5-Br, 6-OH |
| 263 | 2-CN | 6-OH |
| 266 | 2-C(O)-$NH_2$ | 6-OH |
| 267 | 2-$CO_2CH_3$ | 6-OH |
| 297 | 4-Cl | 6-OH |
| 300 | — | 6-OH |

In another aspect provided herein are compounds of Formula (Ia) or a form thereof for use in the methods described herein, wherein the compound is selected from a compound of Formula (Ia6) or a form thereof, wherein substituents $R_{1a}$, when present, are indicated in the table below; and, "- -" indicates that one or more $R_{1a}$ substituents are not present:

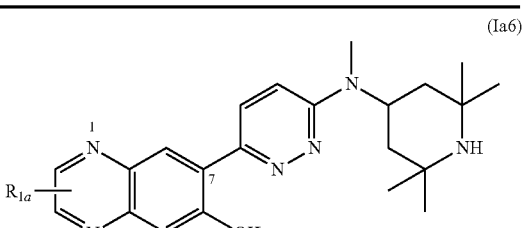

(Ia6)

| Cpd | $R_{1a}$ |
|---|---|
| 239 | — |
| 246 | 2,3-$(CH_3)_2$ |
| 247 | 2-$CH_3$ |
| 248 | 3-$CH_3$ |

In another aspect provided herein are compounds of Formula (Ia) or a form thereof for use in the methods described herein, wherein the compound is selected from a compound of Formula (Ia7) or a form thereof, wherein substituents $R_{1a}$, when present, are indicated in the table below; and, "- -" indicates that one or more $R_{1a}$ substituents are not present:

(Ia7)

| Cpd | $R_{1a}$ |
|---|---|
| 258 | — |
| 260 | 2-CH$_3$ |

In another aspect provided herein are compounds of Formula (Ia) or a form thereof for use in the methods described herein, wherein the compound is selected from a compound of Formula (Ia8) or a form thereof, wherein substituents $R_{1a}$ and B, when present, are indicated in the table below; and, "- -" indicates that one or more $R_{1a}$ and B substituents are not present:

(Ia8)

| Cpd | $R_{1a}$ | B |
|---|---|---|
| 209 | — | 6-((3aR,6aS)-5-CH$_3$-hexahydropyrrolo[3,4-c]pyrrol-2(1H)-yl) |
| 269 | 2-CN | piperazin-1-yl |

In another aspect provided herein are compounds of Formula (Ia) or a form thereof for use in the methods described herein, wherein the compound is selected from a compound of Formula (Ia9) or a form thereof, wherein substituents $R_{1a}$ and B, when present, are indicated in the table below; and "- -" indicates that one or more $R_{1a}$ and B substituents are not resent:

(Ia9)

| Cpd | $R_{1a}$ | B |
|---|---|---|
| 214 | — | 6-((3aR,6aS)-5-CH$_3$-hexahydropyrrolo[3,4-c]pyrrol-2(1H)-yl) |
| 270 | — | piperazin-1-yl |
| 291 | 3-CH$_3$ | piperazin-1-yl |

In another aspect provided herein are compounds of Formula (Ia) or a form thereof for use in the methods described herein, wherein the compound is selected from a compound of Formula (Ia10) or a form thereof, wherein substituents $R_{1a}$ and B, when present, are indicated in the table below; and, "- -" indicates that one or more $R_{1a}$ and B substituents are not present:

(Ia10)

| Cpd | $R_{1a}$ | B |
|---|---|---|
| 268 | 2-CN | piperazin-1-yl |
| 271 | — | 1,2,3,6-tetrahydropyridin-4-yl |

In another aspect provided herein are compounds of Formula (Ia) or a form thereof for use in the methods described herein, wherein the compound is selected from a compound of Formula (Ia11) or a form thereof, wherein substituents A, X and $R_{4a}$, when present, are indicated in the table below; and, "- -" indicates that one or more A, X and $R_{4a}$ substituents are not present:

(Ia11)

| Cpd | A | X | $R_{4a}$ |
|---|---|---|---|
| 2 | benzo[b]thiophen-2-yl | N(CH$_3$) | H |
| 4 | 5-CN-benzo[b]thiophen-2-yl | N(CH$_3$) | H |
| 5 | quinolin-3-yl | NH | H |
| 6 | benzo[b]thiophen-2-yl | O | H |
| 9 | benzo[b]thiophen-2-yl | NH | H |
| 16 | imidazo[1,2-a]pyridin-6-yl | N(CH$_3$) | H |
| 17 | 6-phenyl-pyridin-3-yl | N(CH$_3$) | H |
| 18 | 6-(1H-pyrrol-1-yl)-pyridin-3-yl | N(CH$_3$) | H |
| 19 | 6-(1H-pyrazol-1-yl)-pyridin-3-yl | N(CH$_3$) | H |
| 20 | quinoxalin-2-yl | N(CH$_3$) | H |
| 21 | quinolin-3-yl | N(CH$_3$) | H |
| 22 | phthalazin-6-yl | N(CH$_3$) | H |
| 23 | benzo[c][1,2,5]oxadiazol-5-yl | NH | H |
| 24 | benzo[d]thiazol-5-yl | NH | H |
| 25 | 2-CH$_3$-benzo[d]oxazol-6-yl | NH | H |
| 30 | 2-(4-CN-phenol) | N(CH$_3$) | H |
| 32 | 2(4-CF$_3$-phenol) | N(CH$_3$) | H |
| 33 | 6-(2-F-phenol) | N(CH$_3$) | H |
| 34 | 2-[3,5-(OCH$_3$)$_2$-phenol] | N(CH$_3$) | H |
| 35 | 2-[4,5-(OCH$_3$)$_2$-phenol] | N(CH$_3$) | H |
| 37 | 2-(4,5-F$_2$-phenol) | N(CH$_3$) | H |
| 41 | benzo[b]thiophen-2-yl | NH | CH$_3$ |
| 53 | 2-[4-(1H-pyrazol-1-yl)-phenol] | N(CH$_3$) | H |
| 115 | 2-[3-OH-5-(1H-pyrazol-4-yl)-phenol] | N(CH$_3$) | H |
| 116 | 2-[3-OCH$_3$-5-(1H-pyrazol-4-yl)-phenol] | N(CH$_3$) | H |
| 117 | 2-[5-(1H-pyrazol-4-yl)-3-OCF$_3$-phenol] | NH | H |
| 118 | 2-[5-(1-CH$_3$-1H-pyrazol-4-yl)-3-OCF$_3$-phenol] | N(CH$_3$) | H |
| 119 | 2-[5-(1H-pyrazol-4-yl)-3-OCF$_3$-phenol] | N(CH$_3$) | H |
| 120 | 2-[5-(1-CH$_3$-pyridin-2(1H)-one-3-OCF$_3$-phenol] | N(CH$_3$) | H |
| 121 | 2-[3-OCH$_3$-5-(1-CH$_3$-1H-pyrazol-4-yl)-phenol] | N(CH$_3$) | H |
| 122 | 2-[3-OCH$_3$-5-(5,6,7,8-tetrahydroimidazo-[1,2-a]pyridin-3-yl)-phenol] | N(CH$_3$) | H |
| 123 | 2-[3-OCH$_3$-5-(pyridin-3-yl)-phenol] | N(CH$_3$) | H |
| 124 | 2-[3-OCH$_3$-5-(1-cyclopentyl-1H-pyrazol-4-yl)-phenol] | N(CH$_3$) | H |
| 125 | 2-[5-(3-OCH$_3$-phenyl)-3-OCH$_3$-phenol] | N(CH$_3$) | H |
| 126 | 2-[3-benzyloxy-5-(5-CH$_3$-oxazol-2-yl)-phenol] | N(CH$_3$) | H |
| 127 | 2-[3-OCH$_2$CH$_3$-5-(5-CH$_3$-oxazol-2-yl)-phenol] | N(CH$_3$) | H |
| 128 | 2-[3-(OCH$_2$-cyclopropyl)-5-(5-CH$_3$-oxazol-2-yl)-phenol] | N(CH$_3$) | H |
| 129 | 5-(2-CH$_3$-1H-benzo[d]imidazol-6-ol) | N(CH$_3$) | H |
| 134 | 2-[4-(1H-pyrazol-4-yl)-phenol] | N(CH$_3$) | H |

-continued

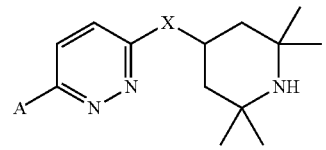

(Ia11)

| Cpd | A | X | R$_{4a}$ |
|---|---|---|---|
| 135 | 2-[4-(4,5,6,7-tetrahydropyrazolo[1,5-a]pyridin-3-yl)-phenol] | N(CH$_3$) | H |
| 136 | 2-[4-(4,5,6,7-tetrahydropyrazolo[1,5-a]pyrazin-3-yl)-phenol] | N(CH$_3$) | H |
| 137 | 2-[4-(1H-indol-2-yl)-phenol] | N(CH$_3$) | H |
| 138 | 2-[4-(cyclopent-1-en-1-yl)-phenol] | N(CH$_3$) | H |
| 139 | 2-[4-(1H-pyrazol-3-yl)-phenol] | N(CH$_3$) | H |
| 140 | 2-[4-(2-OH-pyridin-4-yl)-phenol] | N(CH$_3$) | H |
| 141 | 2[4-(1-CH$_3$-pyridin-2(1H)-one)-phenol] | O | H |
| 142 | 2-[4-(2-OH-pyridin-4-yl)-phenol] | O | H |
| 144 | 2-[4-Cl-5-(1H-pyrazol-4-yl)-phenol] | N(CH$_3$) | H |
| 145 | 2-[4-F-5-(1H-pyrazol-4-yl)-phenol] | N(CH$_3$) | H |
| 146 | 2-[4-F-4-(1H-imidazol-4-yl)-phenol] | N(CH$_3$) | H |
| 147 | 2-[5-F-4-(1H-pyrazol-4-yl)-phenol] | N(CH$_3$) | H |
| 148 | 2-[5-F-(1H-pyrazol-5-yl)-phenol] | N(CH$_3$) | H |
| 149 | 6-OH-1-oxo-2,3-dihydro-1H-inden-5-yl | N(CH$_3$) | H |
| 150 | 6-(1,4-dihydroindeno[1,2-c]-1H-pyrazol-7-ol) | N(CH$_3$) | H |
| 151 | 6-OH-1-OH-imino-2,3-dihydro-1H-inden-5-yl | N(CH$_3$) | H |
| 152 | 6-OH-1-OH-2,3-dihydro-1H-inden-5-yl | N(CH$_3$) | H |
| 153 | 6-(2-NH$_2$-8H-indeno[1,2-d]thiazol-5-ol) | N(CH$_3$) | H |
| 154 | 9-(5,6-dihydroimidazo[5,1-a]isoquinolin-8-ol) | N(CH$_3$) | H |
| 155 | 2-{4-[C(O)NHCH$_2$-(1-CH$_3$-1H-pyrazol-4-yl)]-phenol} | N(CH$_3$) | H |
| 156 | 2-[4-(4-CH$_2$OH-1H-pyrazol-1-yl)-phenol] | N(CH$_3$) | H |
| 158 | 3-(OCH$_2$-phenyl)-isoquinolin-6-yl | N(CH$_3$) | H |
| 160 | 2-[3-F-5-(2-OCH$_3$-pyridin-4-yl)-phenol] | N(CH$_3$) | H |
| 161 | 4-[1-(4-pyridin-2(1H)-one)-3-F-5-OH-phenyl] | N(CH$_3$) | H |
| 162 | 4-{1-[4-(1-CH$_3$-pyridin-2(1H)-one)]-3-F-5-OH-phenyl} | N(CH$_3$) | H |
| 163 | 4-{1-[5-(1-CH$_3$-pyridin-2(1H)-one)]-3-F-5-OH-phenyl} | N(CH$_3$) | H |
| 164 | 2-[3-F-5-(1H-pyrazol-4-yl)-phenol] | O | H |
| 165 | 2-(5-Cl-3-F-phenol) | N(CH$_3$) | H |
| 166 | 2-[3-F-5-(1H-pyrazol-4-yl)-phenol] | N(CH$_3$) | H |
| 167 | 2-[3-F-5-(1-CH$_3$-1H-pyrazol-4-yl)-phenol] | N(CH$_3$) | H |
| 219 | 8-(quinolin-7-ol) | N(CH$_3$) | H |
| 230 | 6-(7-OH-quinolin-2(1H)-one) | N(CH$_3$) | H |
| 231 | 6-(7-OH-1-CH$_3$-quinolin-2(1H)-one) | N(CH$_3$) | H |
| 245 | 7-(6-OH-1-CH$_3$-quinolin-4(1H)-one) | N(CH$_3$) | H |
| 257 | 6-(7-OH-quinazolin-4(1H)-one) | N(CH$_3$) | H |
| 259 | 6-(7-OH-1-CH$_3$-3,4-dihydroquinolin-2(1H)-one) | N(CH$_3$) | H |
| 277 | 7-OH-1,3-(CH$_3$)$_2$-quinazolin-6-yl-2,4(1H,3H)-dione | N(CH$_3$) | H |
| 278 | 6-OH-benzo[d]oxazol-5-yl-2(3H)-one | N(CH$_3$) | H |
| 279 | 2-CH$_3$-6-OH-2H-indazol-5-yl | N(CH$_3$) | H |
| 280 | 1-CH$_3$-6-OH-1H-indazol-5-yl | N(CH$_3$) | H |
| 281 | 7-(6-OH-2-CH$_3$-isoquinolin-1(2H)-one) | N(CH$_3$) | H |
| 282 | 7-(6-OH-2-CH$_2$CH$_3$-isoquinolin-1(2H)-one) | O | H |

In another aspect provided herein are compounds of Formula (Ia) or a form thereof for use in the methods described herein, wherein the compound is selected from a compound of Formula (Ia11) or a form thereof, wherein substituents A, X and R$_{4a}$, when present, are indicated in the table below; and, "- -" indicates that one or more A, X and R$_{4a}$ substituents are not present:

(Ia11)

| Cpd | A | X |
|---|---|---|
| 420 | 2-OCH$_3$-4-(4-NO$_2$-1H-pyrazol-1-yl)phenyl | N(CH$_3$) |
| 428 | 2,5-F$_2$-4-(1H-pyrazol-4-yl)phenyl | N(CH$_3$) |
| 430 | 2,3-F$_2$-4-(1H-pyrazol-4-yl)phenyl | N(CH$_3$) |
| 431 | 2,5-F$_2$-4-(1H-pyrazol-4-yl)phenyl | O |
| 434 | 2-OCH$_3$-4-(1H-pyrazol-4-yl)phenyl | N(CH$_3$) |
| 435 | 4-(1H-pyrazol-4-yl)phenyl | O |
| 437 | 2-F-4-(1H-pyrazol-4-yl)phenyl | O |
| 438 | 4-(1-CH$_3$-1H-pyrazol-4-yl)thiophen-2-yl | O |
| 440 | 2-F-4-OH-phenyl | N(CH$_3$) |
| 442 | 2-CH$_3$-2H-indazol-5-yl | N(CH$_3$) |
| 443 | 2-CH$_3$-2H-indazol-5-yl | O |
| 444 | 4-Cl-2-OCH$_3$-phenyl | O |
| 445 | 2-CH$_3$-pyrazolo[1,5-a]pyridin-3-yl | N(CH$_3$) |
| 446 | imidazo[1,2-a]pyridin-6-yl | O |
| 447 | 2-OCH$_3$-4-(1H-pyrazol-1-yl)phenyl | O |
| 448 | 5-(1H-pyrazol-4-yl)thiophen-2-yl | O |
| 449 | 5-(1-CH$_3$-1H-pyrazol-4-yl)thiophen-2-yl | O |
| 450 | 4-(1H-pyrazol-4-yl)thiophen-2-yl | O |
| 451 | 2-OH-4-[3,5-CH$_3$)$_2$-1H-pyrazol-4-yl]phenyl | O |
| 452 | 2-F-4-(1H-pyrazol-4-yl)phenyl | N(CH$_3$) |
| 453 | 2-OCH$_3$-4-OH-phenyl | O |
| 454 | 2-OCH$_3$-4-(4-NO$_2$-1H-pyrazol-1-yl)phenyl | O |
| 455 | 2,4-(OH)$_2$-phenyl | O |
| 456 | 2-Cl-4-(1H-pyrazol-4-yl)phenyl | N(CH$_3$) |
| 457 | 5-amino-2-(1H-pyrazol-4-yl)pyrimidin-4-yl | O |
| 458 | 2,6-F$_2$-4-(1H-pyrazol-4-yl)phenyl | O |
| 464 | 2-(CHF$_2$)-4-(1H-pyrazol-4-yl)phenyl | O |
| 465 | 2-(CHF$_2$)-4-(1H-pyrazol-4-yl)phenyl | N(CH$_3$) |

In another aspect provided herein are compounds of Formula (Ia) or a form thereof for use in the methods described herein, wherein the compound is selected from a compound of Formula (Ia11) or a form thereof, wherein substituents A, X and R$_{4a}$, when present, are indicated in the table below; and, "- -" indicates that one or more A, X and R$_{4a}$ substituents are not present:

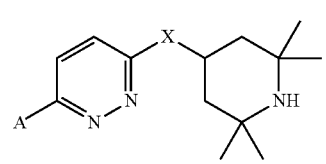

(Ia11)

| Cpd | A | X |
|---|---|---|
| 420 | 2-OCH$_3$-4-(4-NO$_2$-1H-pyrazol-1-yl)phenyl | N(CH$_3$) |
| 428 | 2,5-F$_2$-4-(1H-pyrazol-4-yl)phenyl | N(CH$_3$) |
| 430 | 2,3-F$_2$-4-(1H-pyrazol-4-yl)phenyl | N(CH$_3$) |
| 431 | 2,5-F$_2$-4-(1H-pyrazol-4-yl)phenyl | O |
| 434 | 2-OCH$_3$-4-(1H-pyrazol-4-yl)phenyl | N(CH$_3$) |
| 435 | 4-(1H-pyrazol-4-yl)phenyl | O |
| 437 | 2-F-4-(1H-pyrazol-4-yl)phenyl | O |
| 438 | 4-(1-CH$_3$-1H-pyrazol-4-yl)thiophen-2-yl | O |
| 440 | 2-F-4-OH-phenyl | N(CH$_3$) |
| 442 | 2-CH$_3$-2H-indazol-5-yl | N(CH$_3$) |
| 443 | 2-CH$_3$-2H-indazol-5-yl | O |
| 444 | 4-Cl-2-OCH$_3$-phenyl | O |
| 445 | 2-CH$_3$-pyrazolo[1,5-a]pyridin-3-yl | N(CH$_3$) |
| 446 | imidazo[1,2-a]pyridin-6-yl | O |
| 447 | 2-OCH$_3$-4-(1H-pyrazol-1-yl)phenyl | O |
| 448 | 5-(1H-pyrazol-4-yl)thiophen-2-yl | O |
| 449 | 5-(1-CH$_3$-1H-pyrazol-4-yl)thiophen-2-yl | O |
| 450 | 4-(1H-pyrazol-4-yl)thiophen-2-yl | O |

(Ia11)

| Cpd | A | X |
|---|---|---|
| 451 | 2-OH-4-[3,5-CH₃)₂-1H-pyrazol-4-yl]phenyl | O |
| 452 | 2-F-4-(1H-pyrazol-4-yl)phenyl | N(CH₃) |
| 453 | 2-OCH₃-4-OH-phenyl | O |
| 454 | 2-OCH₃-4-(4-NO₂-1H-pyrazol-1-yl)phenyl | O |
| 455 | 2,4-(OH)₂-phenyl | O |
| 456 | 2-Cl-4-(1H-pyrazol-4-yl)phenyl | N(CH₃) |
| 457 | 5-amino-2-(1H-pyrazol-4-yl)pyrimidin-4-yl | O |
| 458 | 2,6-F₂-4-(1H-pyrazol-4-yl)phenyl | O |
| 464 | 2-(CHF₂)-4-(1H-pyrazol-4-yl)phenyl | O |
| 465 | 2-(CHF₂)-4-(1H-pyrazol-4-yl)phenyl | N(CH₃) |

In another aspect provided herein are compounds of Formula (Ia) or a form thereof for use in the methods described herein, wherein the compound is selected from a compound of Formula (Ia12) or a form thereof, wherein substituents X, $R_{1a}$ and B, when present, are indicated in the table below; and, "- -" indicates that one or more X, $R_{1a}$ and B substituents are not present:

(Ia12)

| Cpd | $R_{1a}$ | X | B |
|---|---|---|---|
| 66 | H | NH | azetidin-3-yl |
| 82 | OH | — | piperazin-1-yl |
| 85 | H | — | 1,2,3,6-tetrahydropyridin-4-yl |
| 86 | OH | — | 1,2,3,6-tetrahydropyridin-4-yl |
| 87 | OH | — | 2,2,6,6-tetramethyl-(1,2,3,6-tetrahydropyridin-4-yl) |
| 88 | OH | — | 1-CH₃-(1,2,3,6-tetrahydropyridin-4-yl) |
| 89 | OH | — | piperidin-4-yl |
| 99 | H | CH₂ | piperidin-4-yl |

In another aspect provided herein are compounds of Formula (Ia) or a form thereof for use in the methods described herein, wherein the compound is selected from a compound of Formula (Ia13) or a form thereof, wherein substituents X, $R_{1a}$ and $R_{4a}$, when present, are indicated in the table below; and, "- -" indicates that one or more X, $R_{1a}$ and $R_{4a}$ substituents are not present:

(Ia13)

| Cpd | X | $R_{1a}$ | $R_{4a}$ |
|---|---|---|---|
| 26 | N(CH₃) | H | H |
| 28 | NH | H | H |
| 31 | O | H | H |
| 90 | O | OH | H |
| 91 | N(CH₃) | OH | H |
| 92 | NH | OH | H |
| 93 | N(CH₃) | O(CH₂)₃NHCO₂C(CH₃)₃ | H |
| 94 | N(CH₃) | O(CH₂)₃NH₂ | H |
| 95 | N(CH₃) | O(CH₂)₃NHCO₂CH₃ | H |
| 96 | N(CH₃) | O(CH₂)₃OH | H |
| 97 | N(CH₃) | O(CH₂)₃OCH₃ | H |
| 98 | O | O(CH₂)₃-morpholin-4-yl | H |
| 103 | N(CH₃) | CN | H |
| 104 | N(CH₃) | CH₂-1-piperidinyl | H |
| 105 | N(CH₃) | CH₂-pyrrolidin-1-yl | H |
| 108 | N(CH₃) | OCH₃ | H |
| 109 | N(CH₃) | OCH₃ | CH₃ |
| 110 | N(CH₃) | 3,6-dihydro-2H-pyran-4-yl | H |
| 111 | N(CH₃) | tetrahydro-2H-pyran-4-yl | H |
| 112 | N(CH₃) | CHF₂ | H |
| 113 | N(CH₃) | OC(CH₃)₂(CH₂)₂OH | H |
| 114 | N(CH₃) | O(CH₂)₂C(CH₃)₂OH | H |

In another aspect provided herein are compounds of Formula (Ia) or a form thereof for use in the methods described herein, wherein the compound is selected from a compound of Formula (Ia14) or a form thereof, wherein substituents X and B, when present, are indicated in the table below; and, "- -" indicates that one or more X and B substituents are not present:

(Ia14)

| Cpd | X | B |
|---|---|---|
| 55 | O | piperidin-4-yl |
| 56 | O | (2S,4R,6R)-2,6-(CH₃)₂-piperidin-4-yl |
| 57 | O | 2,6-(CH₃)₂-piperidin-4-yl |
| 58 | O | pyrrolidin-3-yl |
| 59 | O | 2-CH₃-piperidin-4-yl |
| 60 | OCH₂ | 1H-pyrrolidin-3-yl |
| 61 | O | 3-F-piperidin-4-yl |
| 65 | — | piperazin-1-yl |
| 67 | NH | azetidin-3-1-yl |
| 68 | — | 3,5-(CH₃)₂-piperazin-1-yl |
| 69 | — | 7-CH₃-2,7-diazaspiro[4.4]non-2-yl |
| 70 | — | [1,4]diazepan-1-yl |
| 71 | — | 4-CH₂CH₂OH-piperazin-1-yl |
| 72 | — | 2,7-diazaspiro[3.5]non-7-yl |
| 73 | — | 2,7-diazaspiro[3.5]non-7-yl |
| 74 | — | 3-CH₂OH-piperazin-1-yl |
| 75 | — | 1,7-diazaspiro[4.4]non-7-yl |
| 76 | — | 4-NH₂-4-CH₃-piperidin-1-yl |
| 77 | — | 3-N(CH₃)₂-piperidin-1-yl |

-continued (Ia14)

| Cpd | X | B |
|---|---|---|
| 79 | — | 3,3-$(CH_3)_2$-piperazin-1-yl |
| 80 | — | 7-$CH_2CH_2OH$-2,7-diazaspiro[4.4]-nonan-2-yl |
| 83 | — | 1,2,3,6-tetrahydropyridin-4-yl |
| 84 | — | piperidin-4-yl |
| 102 | O | (6S)-6-[(S)-CH(OH)$CH_3$]-2,2-$(CH_3)_2$-piperidin-4-yl |
| 133 | O | 2,2-$(CH_3)_2$-piperidin-4-yl |

In another aspect provided herein are compounds of Formula (Ia) or a form thereof for use in the methods described herein, wherein the compound is selected from a compound of Formula (Ia15) or a form thereof, wherein substituents X, $R_{1a}$ and $R_{4a}$, when present, are indicated in the table below; and, "- -" indicates that one or more X, $R_{1a}$ and $R_{4a}$ substituents are not present:

(Ia15)

| Cpd | X | $R_{1a}$ | $R_{4a}$ |
|---|---|---|---|
| 3 | NH | H | H |
| 7 | N($CH_3$) | H | H |
| 27 | N($CH_3$) | Cl | $CH_3$ |
| 29 | NH | Cl | $CH_3$ |
| 36 | N($CH_3$) | $OCH_3$ | H |
| 38 | N($CH_3$) | F | H |
| 39 | N($CH_3$) | CN | H |
| 42 | N($CH_3$) | C(O)NH$CH_2$CH=$CH_2$ | H |
| 43 | N($CH_3$) | 1H-pyrazol-1-yl | H |
| 44 | N($CH_3$) | 5-$CH_3$-oxazol-2-yl | H |
| 45 | N($CH_3$) | 4-$CH_2OH$-1H-pyrazole-1-yl | H |
| 46 | N($CH_3$) | 1H-imidazole-1-yl | H |
| 47 | N($CH_3$) | 4-$NH_2$-1H-pyrazol-1-yl | H |
| 48 | N($CH_3$) | 1H-pyrazol-4-yl | H |
| 49 | N($CH_3$) | 3-$NH_2$-1H-pyrazol-1-yl | H |
| 50 | N($CH_3$) | 1-($CH_2CH_2$-morpholin-4-yl)-1H-pyrazol-4-yl | H |
| 51 | N($CH_3$) | 1-$CH_3$-1H-pyrazol-4-yl | H |
| 52 | N($CH_3$) | 5-$NH_2$-1H-pyrazol-1-yl | H |
| 54 | N($CH_2CH_2OH$) | 1H-pyrazol-1-yl | H |
| 62 | O | 1H-pyrazol-1-yl | $CH_3$ |
| 63 | O | 1H-pyrazol-1-yl | H |
| 64 | O | 1H-pyrazol-4-yl | H |
| 78 | NH | 1H-pyrazol-1-yl | $CH_3$ |
| 100 | $CH_2$ | 1H-pyrazol-1-yl | H |
| 130 | N($CH_3$) | Cl | H |
| 131 | NH | 1H-pyrazol-1-yl | H |
| 132 | NH | CN | H |
| 143 | N($CH_3$) | 1H-indazol-7-yl | H |
| 157 | $CH_2$ | 1H-pyrazol-4-yl | H |
| 168 | N($CH_3$) | 5-$OCH_3$-pyridin-3-yl | H |
| 169 | N($CH_3$) | 5-pyridin-2-ol | H |
| 170 | N($CH_3$) | 4-pyridin-2-ol | H. |
| 171 | N($CH_3$) | 6-$OCH_3$-pyridin-3-yl | H |
| 172 | N($CH_3$) | 5-(3-$CF_3$-pyridin-2-ol) | H |
| 173 | N($CH_3$) | 5-(1-$CH_3$-pyridin-2(1H)-one) | H |
| 174 | N($CH_3$) | 4-(1-$CH_3$-pyridin-2(1H)-one) | H |
| 175 | N($CH_3$) | 2-$OCH_3$-pyridin-4-yl | H |
| 176 | O | 4-pyridin-2-ol | H |
| 177 | N($CH_3$) | 6-N($CH_3$)$_2$-pyridin-3-yl | H |
| 178 | O | 4-(1-$CH_3$-pyridin-2(1H)-one) | H |
| 179 | N($CH_3$) | pyrimidin-5-yl | H |
| 180 | N($CH_3$) | 5-pyridin-3-ol | H |
| 181 | N($CH_3$) | 4-(1-cyclopropyl-pyridin-2(1H)-one) | H |
| 182 | N($CH_3$) | 1,2,3,6-tetrahydropyridin-4-yl | H |
| 183 | N($CH_3$) | cyclopent-1-en-1-yl | H |
| 184 | N($CH_3$) | 3,6-dihydro-2H-pyran-4-yl | H |
| 185 | N($CH_3$) | imidazo[1,5-a]pyridin-7-yl | H |
| 186 | N($CH_3$) | imidazo[1,2-a]pyridin-7-yl | H |
| 187 | N($CH_3$) | 2-$CH_3$-pyridin-4-yl | H |
| 188 | N($CH_3$) | 1H-imidazol-2-yl | H |
| 189 | N($CH_3$) | 1H-imidazol-4-yl | H |
| 190 | N($CH_3$) | imidazo[1,2-a]pyrazin-3-yl | H |
| 191 | N($CH_3$) | 5,6,7,8-tetrahydroimidazo[1,2-a]pyrazin-3-yl | H |
| 192 | N($CH_3$) | 4-$CH_3$-1H-imidazol-2-yl | H |
| 193 | N($CH_3$) | 1-$CH_3$-1H-imidazol-4-yl | H |
| 194 | N($CH_3$) | 1-$CH_3$-1H-imidazol-5-yl | H |
| 195 | N($CH_3$) | 4-$NO_2$-1H-imidazol-2-yl | H |
| 196 | N($CH_3$) | 2-$CH_3$-1H-imidazol-4-yl | H |
| 197 | N($CH_3$) | 1,2-($CH_3$)$_2$-1H-imidazol-4-yl | H |
| 198 | N($CH_3$) | 4-C(O)$NH_2$-1H-pyrazol-1-yl | H |
| 206 | N($CH_3$) | H | H |

In another aspect provided herein are compounds of Formula (Ia) or a form thereof for use in the methods described herein, wherein the compound is selected from a compound of Formula (Ia15) or a form thereof, wherein substituents X, $R_{1a}$ and $R_{4a}$, when present, are indicated in the table below; and, "- -" indicates that one or more X, $R_{1a}$ and $R_{4a}$ substituents are not present:

(Ia15)

| Cpd | X | $R_{1a}$ |
|---|---|---|
| 413 | NH | 1H-pyrazol-4-yl |
| 414 | O | 1-$CH_3$-1H-pyrazol-4-yl |
| 416 | N($CH_3$) | 5-$CH_3$-1H-pyrazol-4-yl |
| 417 | O | 1H-imidazol-1-yl |
| 418 | O | 5-$CH_3$-1H-pyrazol-4-yl |
| 419 | N($CH_3$) | 4-$NO_2$-1H-pyrazol-1-yl |
| 421 | O | 4-$NH_2$-1H-pyrazol-1-yl |
| 423 | O | 4-$NO_2$-1H-pyrazol-1-yl |
| 460 | N($CH_3$) | 1H-pyrazol-4-yl |
| 461 | O | 1H-pyrazol-4-yl |

In another aspect provided herein are compounds of Formula (Ia) or a form thereof for use in the methods described herein, wherein the compound is selected from a compound of Formula (Ia16) or a form thereof, wherein substituents $R_{1a}$ and $R_{4a}$, when present, are indicated in the table below; and, "- -" indicates that one or more $R_{1a}$ and $R_{4a}$ substituents are not present:

(Ia16)

| Cpd | $R_{1a}$ | $R_{4a}$ |
|---|---|---|
| 81 | 1H-pyrazol-1-yl | — |
| 199 | 1H-pyrazol-4-yl | $(CH_2)_2OH$ |
| 200 | 1H-pyrazol-4-yl | — |
| 201 | 1H-pyrazol-4-yl | $CH_3$ |
| 202 | 4-(1-$CH_3$-pyridin-2(1H)-one) | $CH_3$ |
| 203 | 4-(1-$CH_3$-pyridin-2(1H)-one) | $CH_3$ |

In another aspect provided herein are compounds of Formula (Ia) or a form thereof for use in the methods described herein, wherein the compound is selected from a compound of Formula (Ia17) or a form thereof, wherein substituent $R_{1a}$, when present, is indicated in the table below; and, "- -" indicates that one or more $R_{1a}$ substituents are not present:

(Ia17)

| Cpd | $R_{1a}$ |
|---|---|
| 204 | 1H-pyrazol-4-yl |
| 205 | 4-(1-$CH_3$-pyridin-2(1H)-one |

In another aspect provided herein are compounds of Formula (Ia) or a form thereof for use in the methods described herein, wherein the compound is selected from a compound of Formula (Ia18) or a form thereof, wherein substituent X and B, when present, is indicated in the table below; and, "- -" indicates that one or more X and B substituents are not present:

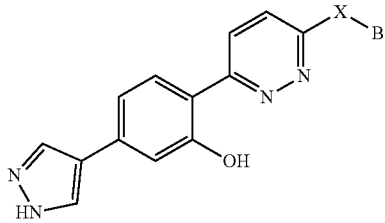

(Ia18)

| Cpd | X | B |
|---|---|---|
| 411 | $N(CH_3)$ | (1R,5S)-8-azabicyclo[3.2.1]oct-3-yl |
| 412 | NH | (1R,5S)-8-azabicyclo[3.2.1]oct-3-yl |
| 415 | O | (1R,5S)-8-azabicyclo[3.2.1]oct-3-yl |
| 422 | — | 1-$CH_3$-(1,2,3,6-tetrahydropyridin-4-yl) |
| 424 | — | 1,2,3,6-tetrahydropyridin-4-yl |
| 425 | — | 1-$CH_3CH_2$-(1,2,3,6-tetrahydropyridin-4-yl) |
| 426 | $N(CH_3)$ | piperidin-4-yl |
| 427 | NH | piperidin-4-yl |
| 429 | — | 8-azabicyclo[3.2.1]oct-2-en-3-yl |
| 432 | O | piperidin-4-yl |
| 433 | NH | (1R,5S)-8-azabicyclo[3.2.1]oct-3-yl |
| 436 | O | 2,6-$(CH_3)_2$-piperidin-4-yl |
| 439 | — | 2,7-diazaspiro[3.5]non-2-yl |
| 441 | O | 2,6-$(CH_3)_2$-piperidin-4-yl |
| 459 | — | 2,6-diazaspiro[3.4]oct-2-yl |

In another aspect provided herein are compounds of Formula (Ia) or a form thereof for use in the methods described herein, wherein the compound is selected from a compound of Formula (Ia18) or a form thereof, wherein substituents X, $R_{1a}$ and B, when present, are indicated in the table below; and, "- -" indicates that one or more X, $R_{1a}$ and B substituents are not present:

(Ia18)

| Cpd | X | B |
|---|---|---|
| 411 | $N(CH_3)$ | (1R,5S)-8-azabicyclo[3.2.1]oct-3-yl |
| 412 | NH | (1R,5S)-8-azabicyclo[3.2.1]oct-3-yl |
| 415 | O | (1R,5S)-8-azabicyclo[3.2.1]oct-3-yl |
| 422 | — | 1-$CH_3$-(1,2,3,6-tetrahydropyridin-4-yl) |
| 424 | — | 1,2,3,6-tetrahydropyridin-4-yl |
| 425 | — | 1-$CH_3CH_2$-(1,2,3,6-tetrahydropyridin-4-yl) |
| 426 | $N(CH_3)$ | piperidin-4-yl |
| 427 | NH | piperidin-4-yl |
| 429 | — | 8-azabicyclo[3.2.1]oct-3-yl |
| 432 | O | piperidin-4-yl |
| 433 | NH | (1R,5S)-8-azabicyclo[3.2.1]oct-3-yl |
| 436 | O | 2,6-$(CH_3)_2$-piperidin-4-yl |
| 439 | — | 2,7-diazaspiro[3.5]non-2-yl |
| 441 | O | 2,6-$(CH_3)_2$-piperidin-4-yl |
| 459 | — | 2,6-diazaspiro[3.4]oct-2-yl |

In another aspect provided herein are compounds of Formula (Ib) or a form thereof for use in the methods described herein, wherein the compound is selected from a compound of Formula (Ib1) or a form thereof, wherein substituent A is indicated in the table below:

(Ib1)

| Cpd | A |
|---|---|
| 302 | 6-(naphthalen-2-ol) |
| 320 | 6-(naphthalen-2,7-diol) |
| 331 | 7-OCH$_3$-quinolin-6-yl |
| 332 | 7-OH-quinolin-6-yl |
| 337 | 2-CN-7-OCH$_3$-quinolin-6-yl |
| 355 | 3-F-5-(1H-pyrazol-4-yl)-pyridin-2-yl |
| 364 | 2-(6-OCH$_3$-3,4-dihydroisoquinolin-1(2H)-one) |
| 392 | 6-OH-1-oxo-2,3-dihydro-1H-inden-5-yl |
| 401 | 3-(4-OCH$_3$-1-CH$_3$-quinolin-2(1H)-one) |
| 402 | 3-(4-OH-1-CH$_3$-quinolin-2(1H)-one) |
| 403 | 3-(quinolin-2(1H)-one) |
| 404 | 3-(1-OCH$_3$-quinolin-2(1H)-one) |
| 408 | 5-CN-benzo[b]thiophen-2-yl |
| 409 | 3-Cl-benzo[b]thiophen-2-yl |

In another aspect provided herein are compounds of Formula (Ib) or a form thereof for use in the methods described herein, wherein the compound is selected from a compound of Formula (Ib1) or a form thereof, wherein substituent A is indicated in the table below: c

| Cpd | A |
|---|---|
| 462 | 3-(1H-pyrazol-4-yl)phenoxy |
| 463 | 4-(1H-pyrazol-4-yl)phenoxy |

In another aspect provided herein are compounds of Formula (Ib) or a form thereof for use in the methods described herein, wherein the compound is selected from a compound of Formula (Ib1) or a form thereof, wherein substituent A is indicated in the table below:

(Ib1)

| Cpd | A |
|---|---|
| 462 | 3-(1H-pyrazol-4-yl)phenoxy |
| 463 | 4-(1H-pyrazol-4-yl)phenoxy |

In another aspect provided herein are compounds of Formula (Ib) or a form thereof for use in the methods described herein, wherein the compound is selected from a compound of Formula (Ib2) or a form thereof, wherein substituent A is indicated in the table below:

(Ib2)

| Cpd | A |
|---|---|
| 321 | 6-naphthalen-2,7-diol |

In another aspect provided herein are compounds of Formula (Ib) or a form thereof for use in the methods described herein, wherein the compound is selected from a compound of Formula (Ib3) or a form thereof, wherein substituents R$_{1a}$, R$_{1b}$ and B, when present, are indicated in the table below; and, "- -" indicates that one or more R$_{1a}$, R$_{1b}$ and B substituents are not present:

(Ib3)

| Cpd | R$_{1a}$ | R$_{1b}$ | B |
|---|---|---|---|
| 329 | 1H-pyrazol-1-yl | OCH$_3$ | 1,2,3,6-tetrahydropyridin-4-yl |
| 330 | 1H-pyrazol-1-yl | OH | piperazin-1-yl |
| 381 | 1H-pyrazol-1-yl | Cl | 5-((3aR,6aR)-1-CH$_3$-hexahydropyrrolo[3,4-b]pyrrol-5(1H)-yl) |
| 382 | 1H-pyrazol-1-yl | Cl | 2-NHCH(CH$_3$)$_2$-morpholin-4-yl |
| 383 | 1H-pyrazol-1-yl | Cl | 2-OCH$_3$-2,7-diazaspiro[4.5]decan-7-yl |
| 385 | 1-CH$_3$-1H-pyrazol-4-yl | OCH$_3$ | 5-((3aR,6aS)-5-CH$_3$-hexahydropyrrolo[3,4-c]pyrrol-2(1H)-yl) |
| 394 | 1-CH$_3$-1H-pyrazol-4-yl | OH | 5-((3aR,6aS)-5-CH$_3$-hexahydropyrrolo[3,4-c]pyrrol-2(1H)-yl) |
| 406 | 1H-pyrazol-1-yl | Cl | 2,7-diazaspiro[4.5]decan-2-yl |
| 407 | 1H-pyrazol-1-yl | Cl | (3R)-(3-(R)-(CH$_2$OH)-piperazin-1-yl) |

In another aspect provided herein are compounds of Formula (Ib) or a form thereof for use in the methods described herein, wherein the compound is selected from a compound of Formula (Ib) or a form thereof, wherein substituents R$_{1a}$, R$_{1b}$, R$_{1c}$, R$_{1d}$ (each representative of the scope of R$_1$) and X, when present, are indicated in the table below; and, "- -" indicates that one or more $R_{1a}$, $R_{1b}$, $R_{1c}$, $R_{1d}$ and X substituents are not present:

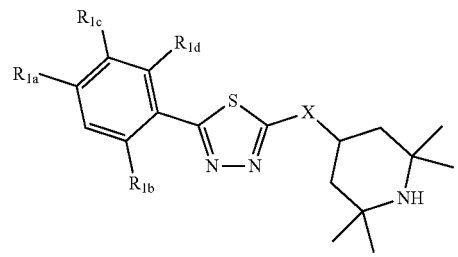

(Ib4)

| Cpd | $R_{1a}$ | $R_{1b}$ | $R_{1c}$ | $R_{1d}$ | X |
|---|---|---|---|---|---|
| 301 | 1H-pyrazol-1-yl | OCH₃ | H | H | N(CH₃) |
| 305 | 1H-pyrazol-1-yl | OCH₃ | H | H | N(CH₃) |
| 306 | 1-CH₃-1H-pyrazol-4-yl | OCH₃ | H | H | N(CH₃) |
| 307 | 1H-pyrazol-4-yl | OCH₃ | H | H | N(CH₃) |
| 308 | 4-(1-CH₃-pyridin-2(1H)-one) | OCH₃ | H | H | N(CH₃) |
| 309 | 5-pyridin-2-ol | OCH₃ | H | H | N(CH₃) |
| 310 | 5-(1-CH₃-pyridin-2(1H)-one) | OCH₃ | H | H | N(CH₃) |
| 311 | 1-CH₃-1H-pyrazol-4-yl | CH₃ | H | H | N(CH₃) |
| 312 | 4-(1-CH₃-pyridin-2(1H)-one) | OCF₃ | H | H | N(CH₃) |
| 313 | 3,5-(CH₃)₂-1H-pyrazol-4-yl | OCH₃ | H | H | N(CH₃) |
| 314 | 1-CH₃-1H-pyrazol-4-yl | CF₃ | H | H | N(CH₃) |
| 315 | 1-CH₃-1H-pyrazol-4-yl | OH | H | H | N(CH₃) |
| 316 | 1H-pyrazol-1-yl | OH | H | H | N(CH₃) |
| 317 | 5-(1-CH₃-pyridin-2(1H)-one) | OH | H | H | N(CH₃) |
| 318 | 4-(1-CH₃-pyridin-2(1H)-one) | OH | H | H | N(CH₃) |
| 319 | 5-pyridin-2-ol | OH | H | H | N(CH₃) |
| 324 | H | OH | 1H-pyrazol-1-yl | H | N(CH₃) |
| 325 | 1-CH₃-1H-pyrazol-4-yl | H | H | Cl | N(CH₃) |
| 326 | 1-CH₃-1H-pyrazol-4-yl | OH | H | Cl | N(CH₃) |
| 327 | 1-CH₃-1H-pyrazol-4-yl | H | H | Cl | N(CH₃) |
| 328 | 5-CH₃-oxazol-2-yl | OH | H | OCH₃ | N(CH₃) |
| 333 | CN | OCH₃ | H | H | N(CH₃) |
| 334 | CN | F | H | H | N(CH₃) |
| 335 | CO₂CH₃ | F | H | H | N(CH₃) |
| 336 | 3-NHCH₃-1H-pyrazol-1-yl | OCH₃ | H | H | N(CH₃) |
| 338 | 4-(1-CH₃-pyridin-2(1H)-one) | OCH₃ | H | H | N(CH₃) |
| 339 | 4-(1-CH₃-pyridin-2(1H)-one) | Cl | H | H | N(CH₃) |
| 340 | 1H-pyrazol-4-yl | Cl | H | H | N(CH₃) |
| 341 | 4,5,6,7-tetrahydropyrazolo[1,5-a]pyridin-3-yl | Cl | H | H | N(CH₃) |
| 343 | 1-CH₃-1H-pyrazol-4-yl | Cl | H | H | O |
| 344 | 6-OCH₃-pyridin-3-yl | Cl | H | H | N(CH₃) |
| 345 | 6-NH₂-pyridin-3-yl | F | H | H | N(CH₃) |
| 346 | 3-CH₃-1H-pyrazol-5-yl | F | H | H | N(CH₃) |
| 347 | 1H-pyrazol-5-yl | F | H | H | N(CH₃) |
| 348 | 1H-pyrazol-4-yl | H | F | F | N(CH₃) |
| 349 | 1H-pyrazol-5-yl | H | F | F | N(CH₃) |
| 350 | 1H-pyrazol-4-yl | F | F | H | N(CH₃) |
| 351 | 1H-pyrazol-5-yl | F | F | H | N(CH₃) |
| 352 | 1H-pyrazol-4-yl | F | H | F | N(CH₃) |
| 354 | 1H-pyrazol-4-yl | Cl | F | H | N(CH₃) |
| 356 | 2-NH₂-pyrimidin-4-yl | Cl | H | H | N(CH₃) |
| 357 | H | Cl | 2-NH₂-pyrimidin-4-yl | H | N(CH₃) |
| 358 | 2,4-(CH₃)₂-thiazol-5-yl | F | F | H | N(CH₃) |
| 359 | 2,4-(CH₃)₂-thiazol-5-yl | H | F | F | N(CH₃) |
| 360 | 4-(1-CH₃-pyridin-2(1H)-one) | OH | H | OCF₃ | N(CH₃) |
| 361 | 1H-pyrazol-4-yl | OCH₃ | H | F | N(CH₃) |
| 363 | 1H-pyrazol-4-yl | OCH₃ | F | F | N(CH₃) |
| 365 | 1H-pyrazol-1-yl | Cl | H | H | N(CH₃) |
| 366 | 1H-1,2,3-triazol-1-yl | Cl | H | H | N(CH₃) |
| 367 | 2H-1,2,3-triazol-2-yl | Cl | H | H | N(CH₃) |
| 368 | 1H-1,2,4-triazol-1-yl | Cl | H | H | N(CH₃) |
| 369 | 3-NH₂-1H-pyrazol-1-yl | Cl | H | H | N(CH₃) |
| 371 | 1H-imidazol-1-yl | Cl | H | H | N(CH₃) |
| 372 | 1H-imidazol-1-yl | F | H | H | N(CH₃) |
| 373 | 1H-pyrazol-5-yl | OCH₃ | H | H | N(CH₃) |
| 374 | 2,4-(CH₃)₂-thiazol-5-yl | OCH₃ | H | H | N(CH₃) |
| 375 | pyridin-3-yl | OCH₃ | H | H | N(CH₃) |
| 376 | 1H-pyrazol-4-yl | F | H | H | N(CH₃) |
| 377 | 2-OCH₃-pyridin-4-yl | OCH₃ | H | H | N(CH₃) |
| 378 | 6-OCH₃-pyridin-3-yl | OCH₃ | H | H | N(CH₃) |

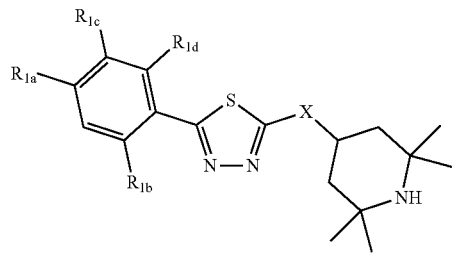

(Ib4)

| Cpd | $R_{1a}$ | $R_{1b}$ | $R_{1c}$ | $R_{1d}$ | X |
|---|---|---|---|---|---|
| 387 | 1H-pyrazol-1-yl | OH | H | H | $N(CH_3)$ |
| 388 | 5-(pyridin-2(1H)-one) | Cl | H | H | $N(CH_3)$ |
| 389 | 3-$NHCH_3$-1H-pyrazol-1-yl | OH | H | H | $N(CH_3)$ |
| 390 | 1H-pyrazol-4-yl | OH | H | F | $N(CH_3)$ |
| 391 | 1H-pyrazol-4-yl | OH | F | F | $N(CH_3)$ |
| 393 | 1H-pyrazol-4-yl | OH | H | H | $N(CH_3)$ |
| 397 | 1H-pyrazol-4-yl | OH | H | Cl | $N(CH_3)$ |
| 398 | 1H-pyrazol-1-yl | $OCH_3$ | H | H | $CH_2$ |
| 410 | 1H-pyrazol-4-yl | $OCH_3$ | H | H | $N(CH_3)$ |

In another aspect provided herein are compounds of Formula (Ib) or a form thereof for use in the methods described herein, wherein the compound is selected from a compound of Formula (Ib5) or a form thereof, wherein substituents $R_{1a}$, $R_{1b}$, $R_{1c}$, $R_{1d}$ (each representative of the scope of $R_1$) and $R_{4a}$, when present, are indicated in the table below; and, "- -" indicates that one or more $R_{1a}$, $R_{1b}$, $R_{1c}$, $R_{1d}$ and $R_{4a}$ substituents are not present:

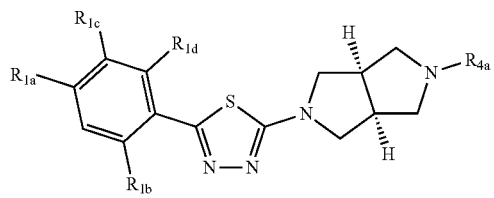

(Ib5)

| Cpd | $R_{1a}$ | $R_{1b}$ | $R_{1c}$ | $R_{1d}$ | $R_{4a}$ |
|---|---|---|---|---|---|
| 353 | 1H-pyrazol-4-yl | F | F | H | — |
| 362 | 1H-pyrazol-4-yl | $OCH_3$ | H | F | $CH_3$ |
| 370 | 1H-imidazol-1-yl | Cl | H | H | $CH_3$ |
| 379 | 1-$CH_3$-1H-pyrazol-4-yl | Cl | H | H | $CH_3$ |
| 380 | 1H-pyrazol-4-yl | Cl | H | H | $CH_3$ |
| 384 | 1H-pyrazol-4-yl | F | H | H | $CH_3$ |
| 396 | 1H-pyrazol-4-yl | F | H | OH | — |
| 405 | 1H-pyrazol-4-yl | Cl | H | H | — |

In another aspect provided herein are compounds of Formula (Ib) or a form thereof for use in the methods described herein, wherein the compound is selected from a compound of Formula (Ib6) or a form thereof, wherein (substituents $R_{1a}$, $R_{1b}$, $R_{1c}$ and $R_{1d}$ (each representative of the scope of $R_1$), when present, are indicated in the table below; and, "- -" indicates that one or more $R_{1a}$, $R_{1b}$, $R_{1c}$ and $R_{1d}$ substituents are not present:

(Ib6)

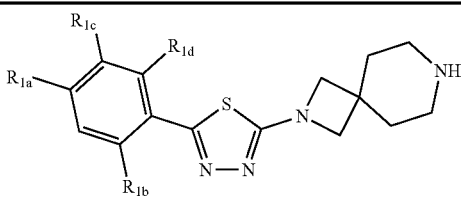

| Cpd | $R_{1a}$ | $R_{1b}$ | $R_{1c}$ | $R_{1d}$ |
|---|---|---|---|---|
| 386 | 1-$CH_3$-1H-pyrazol-4-yl | $OCH_3$ | H | H |
| 395 | 1-$CH_3$-1H-pyrazol-4-yl | OH | H | H |
| 399 | 1H-pyrazol-4-yl | H | F | F |
| 400 | 1H-pyrazol-4-yl | OH | H | F |

In another aspect provided herein are compounds of Formula (Ib) or a form thereof for use in the methods described herein, wherein the compound is selected from a compound of Formula (Ib7) or a form thereof, wherein substituent $R_{1b}$, when present, is indicated in the table below:

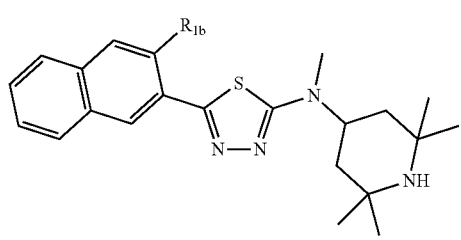

(Ib7)

| Cpd | $R_{1b}$ |
|---|---|
| 304 | $OCH_3$ |
| 322 | OH |

In another aspect provided herein are compounds of Formula (Ib) or a form thereof for use in the methods described herein, wherein the compound is selected from a compound of Formula (Ib8) or a form thereof, wherein substituent $R_{1b}$, when present, is indicated in the table

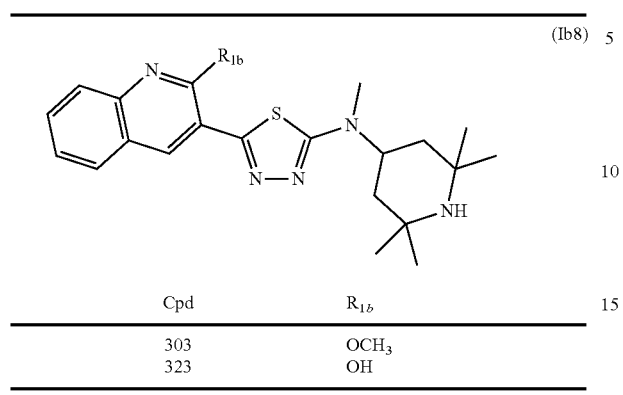

| Cpd | $R_{1b}$ |
|---|---|
| 303 | OCH₃ |
| 323 | OH |

Preparation of Compounds

Compounds provided herein can be prepared by those skilled in the art, such as, by the synthetic methods set forth in International Application Number PCT/US2013/054687 filed Aug. 13, 2013 and published as International Publication Number WO2014/028459 on Feb. 20, 2014; International Application Number PCT/US2014/012774 filed Jan. 23, 2014 and published as International Publication Number WO2014/116845 A1 on Jul. 31, 2014; International Application Number PCT/US2014/048984 filed Jul. 30, 2014 and published as International Publication Number WO2015/017589 on Feb. 5, 2015; and, International Application Number PCT/US2016/066042 filed Dec. 11, 2016 and published as International Publication Number WO2017/100726 on Jun. 15, 2017, each of which are incorporated by reference in their entirety as if fully set forth herein.

In one aspect, the compound of Formula (I) used in a method disclosed herein is a compound selected from the group consisting of:

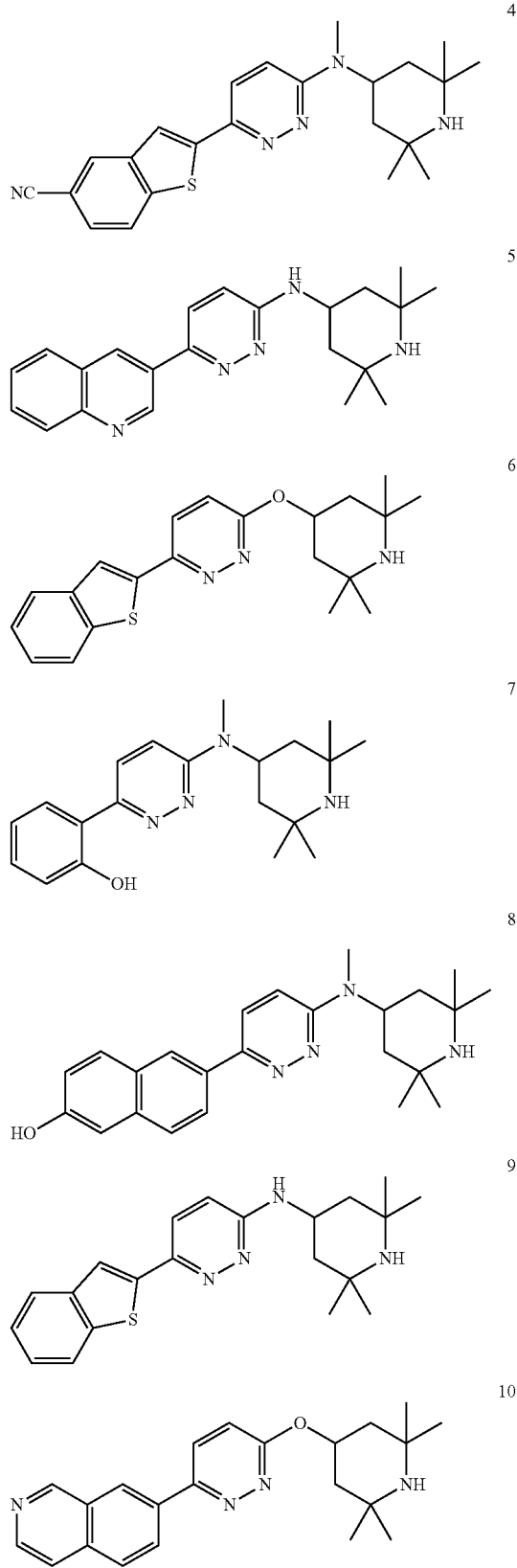

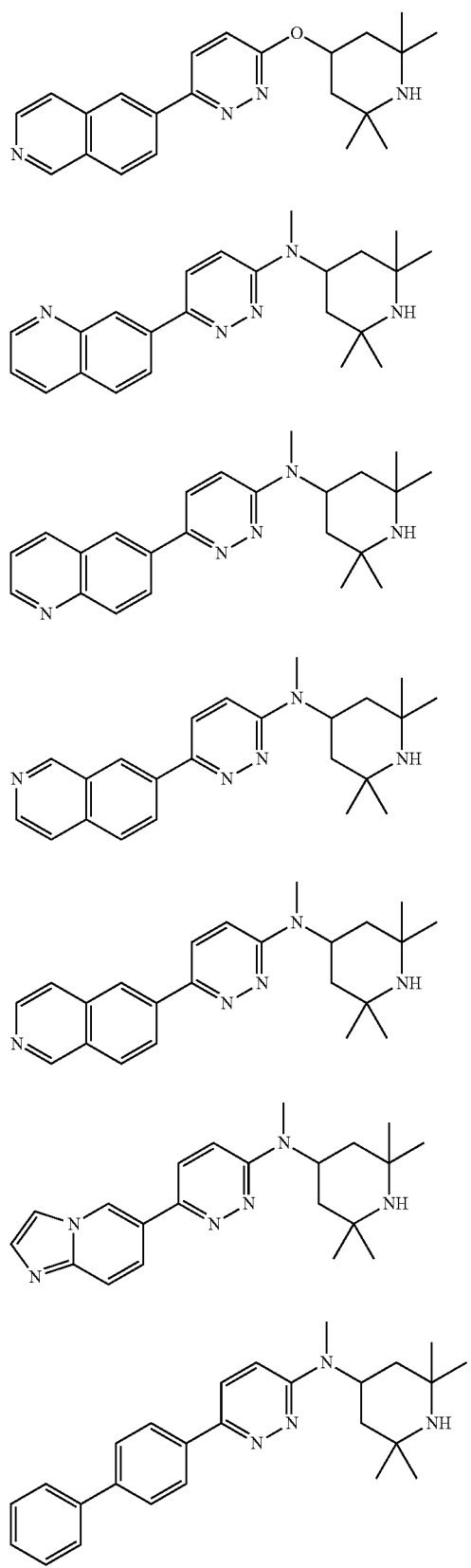
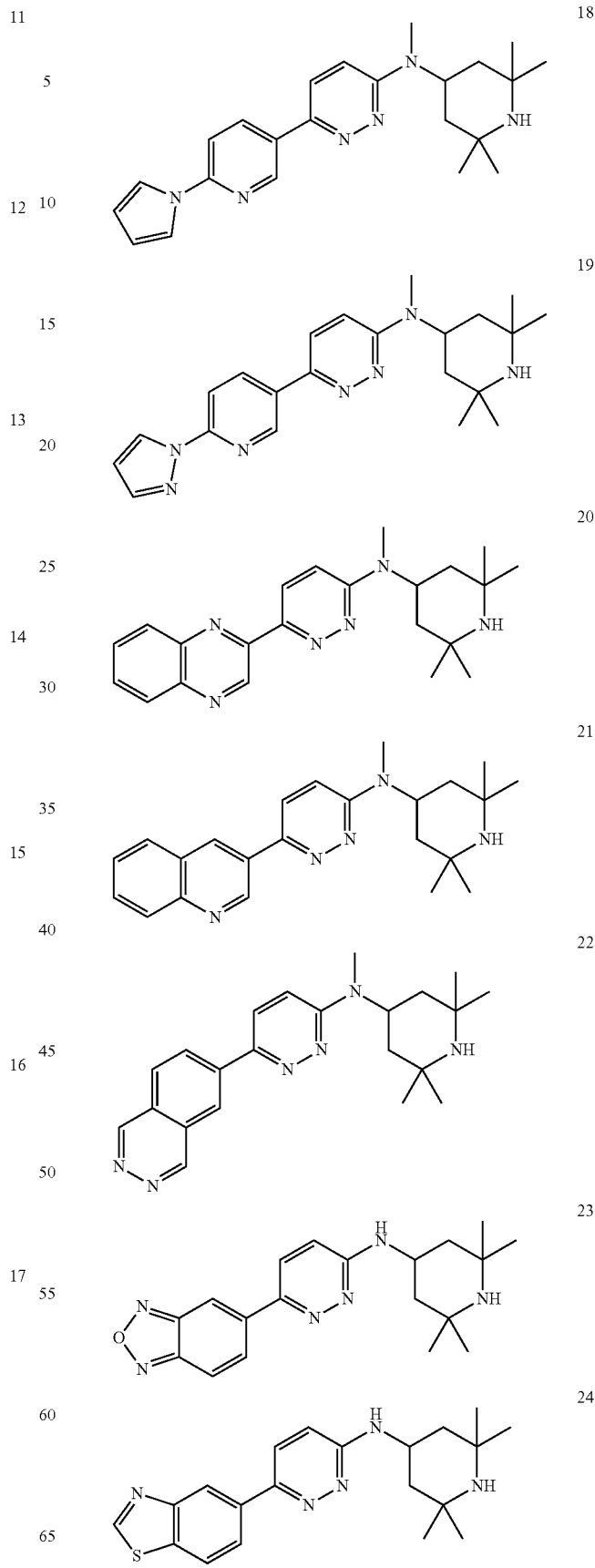

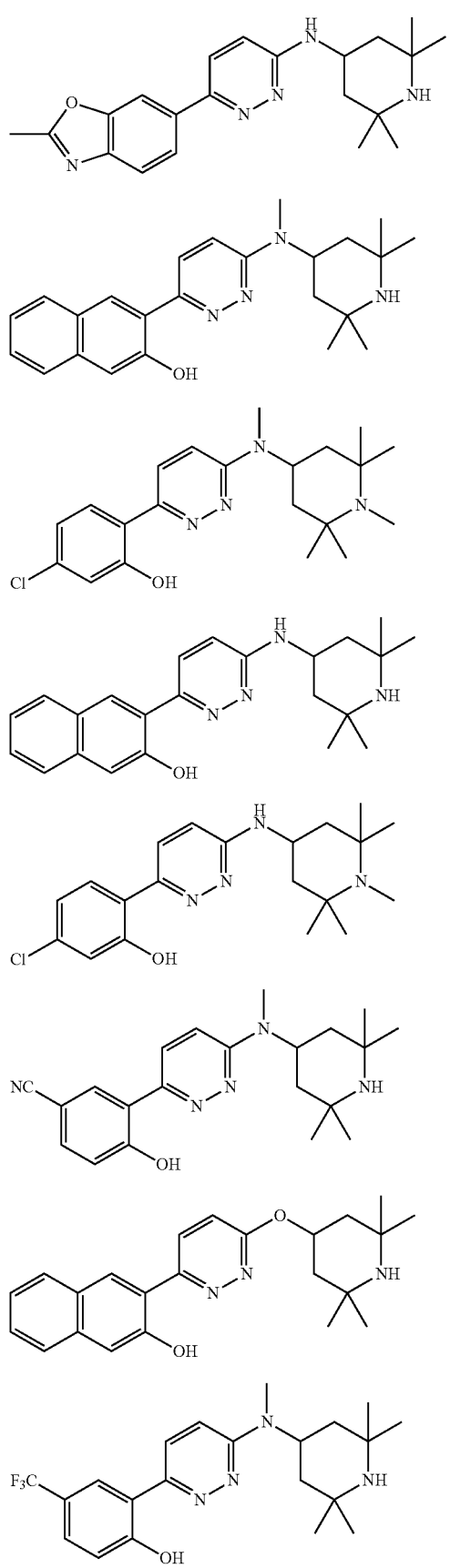
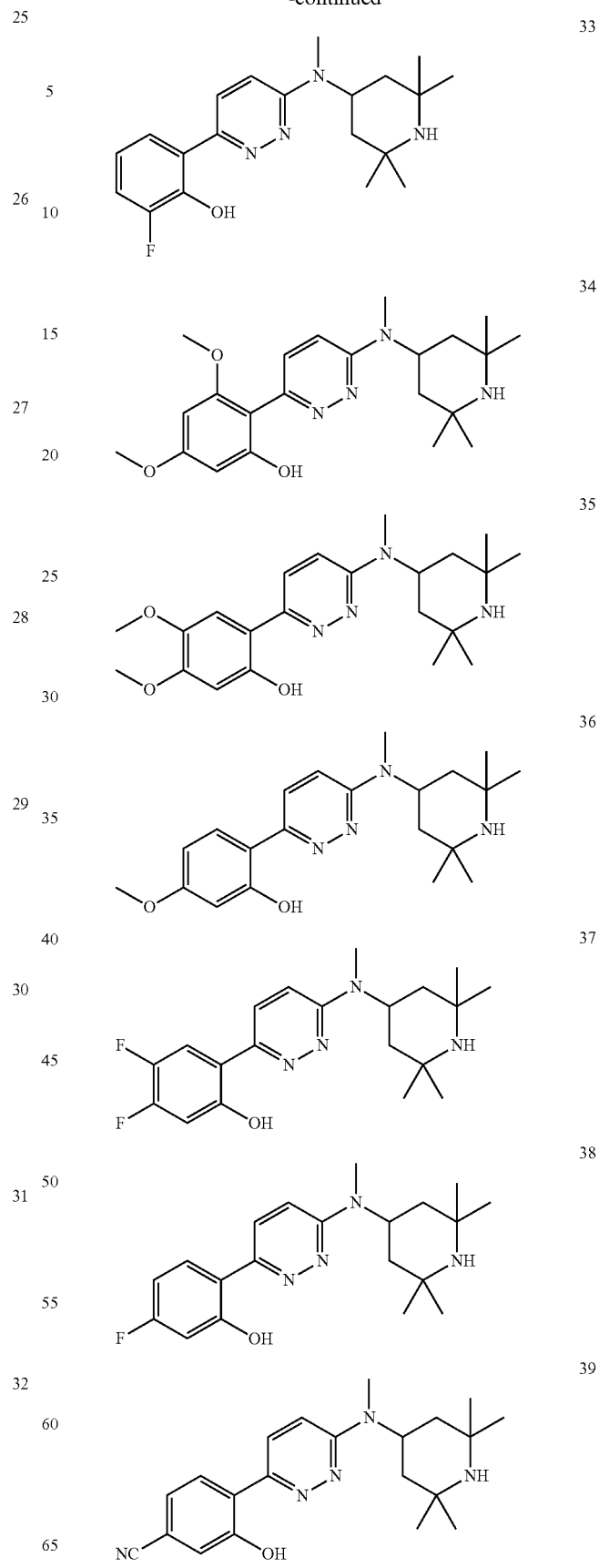

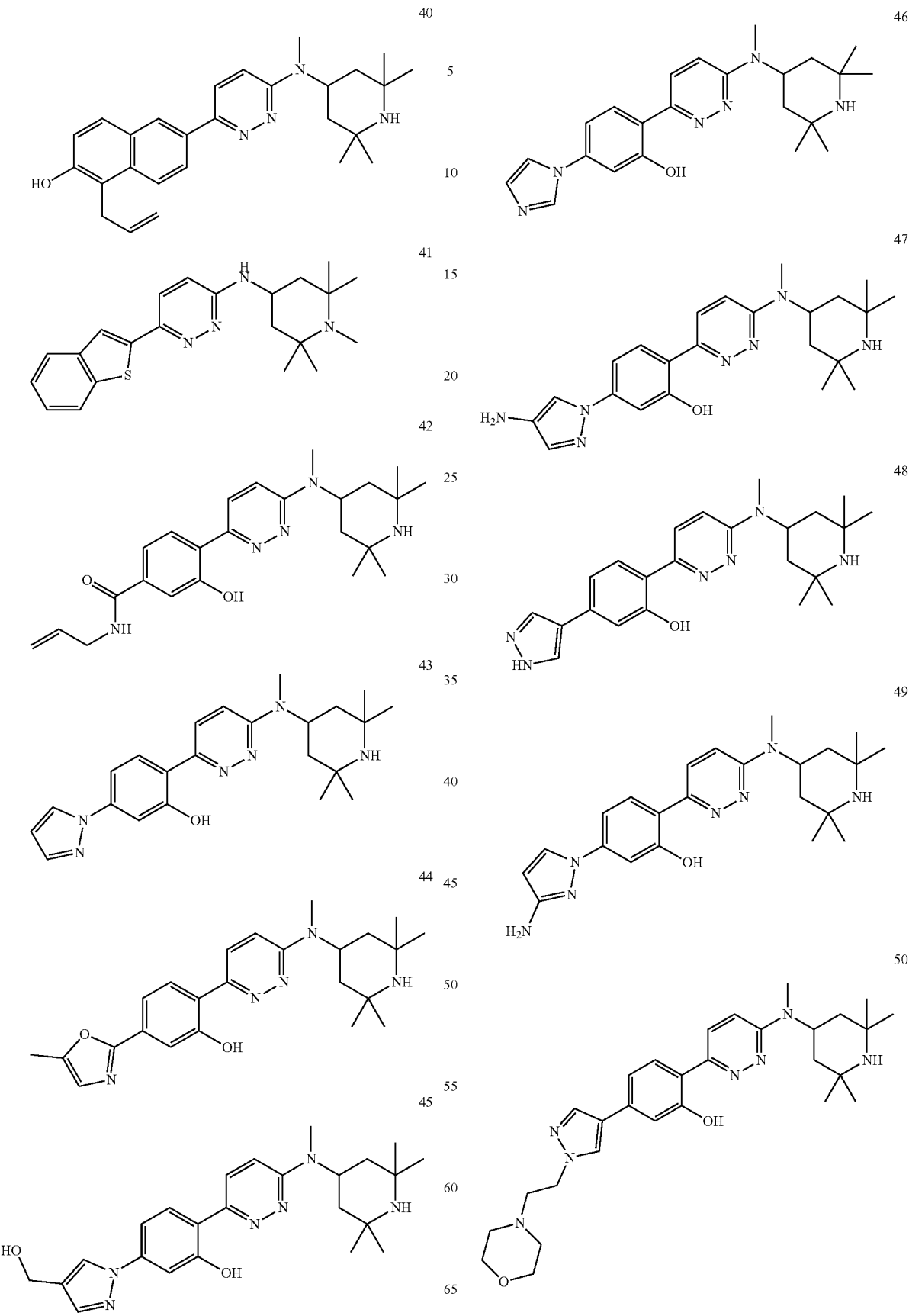

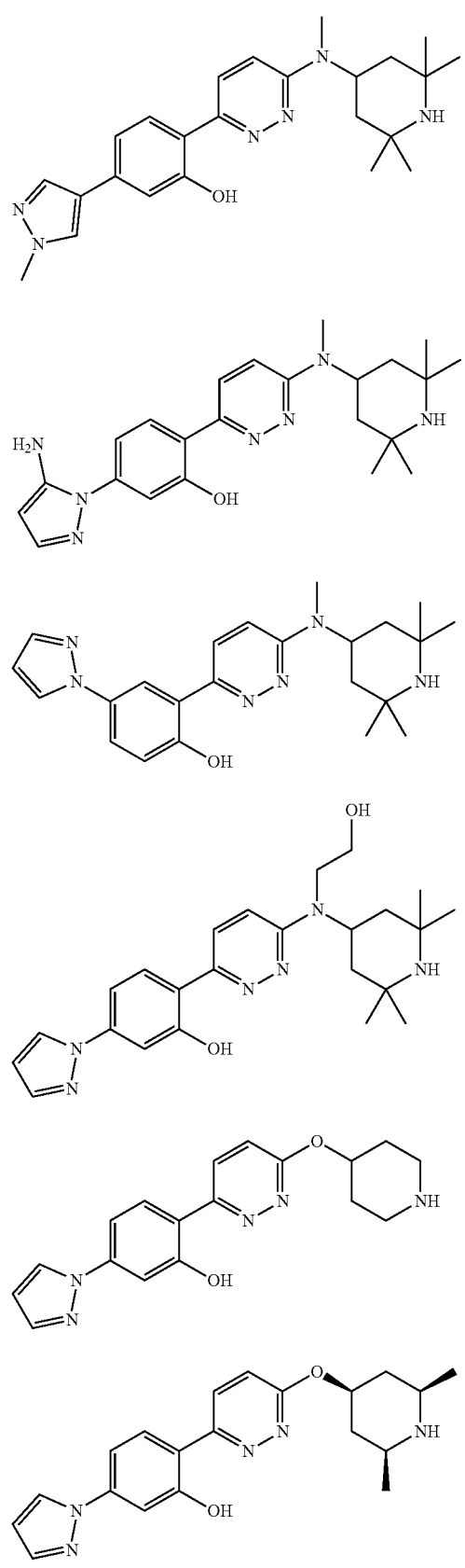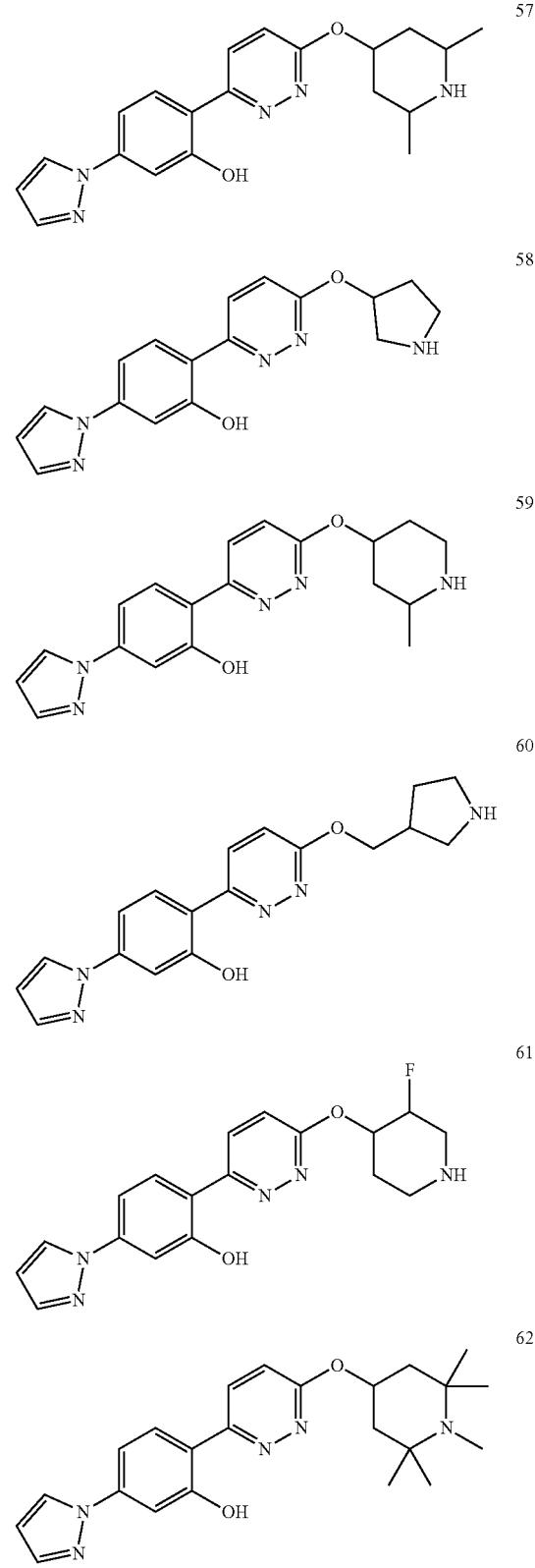

201
-continued
63
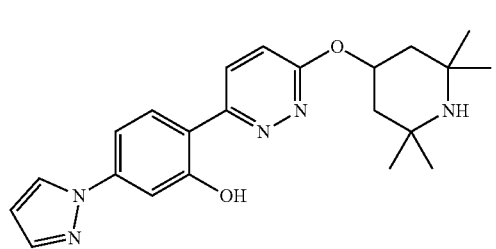
64
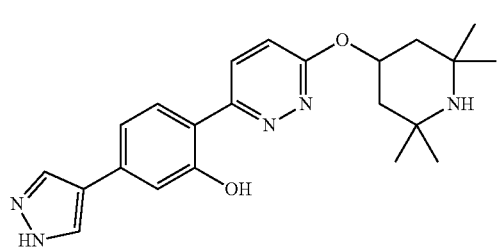 [SMILES: CC1(C)CC(Oc2ccc(-c3ccc(-c4cn[nH]c4)cc3O)nn2)CC(C)(C)N1]
65
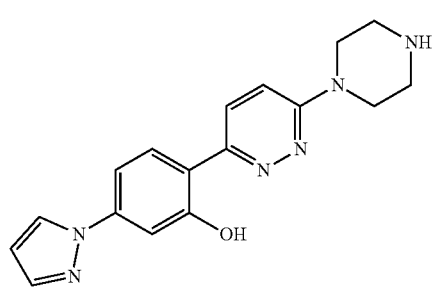
66
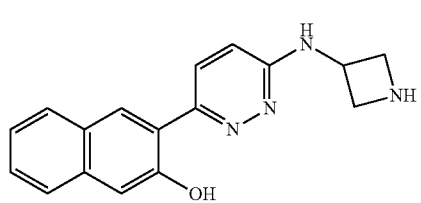
67
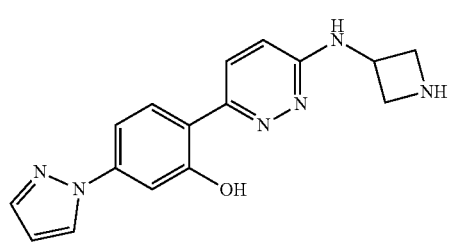
68
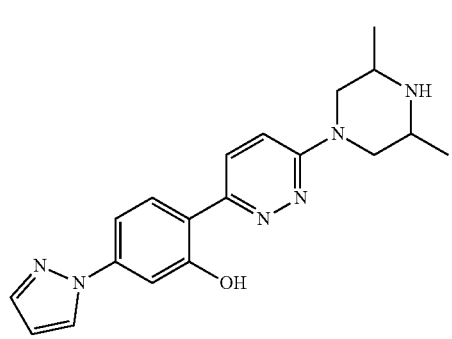
202
-continued
69
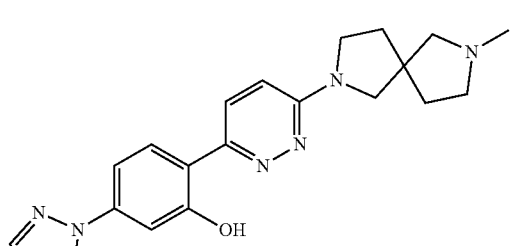
70
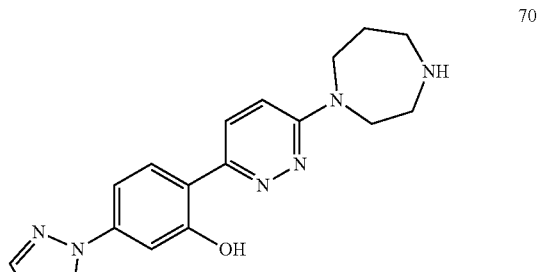
71
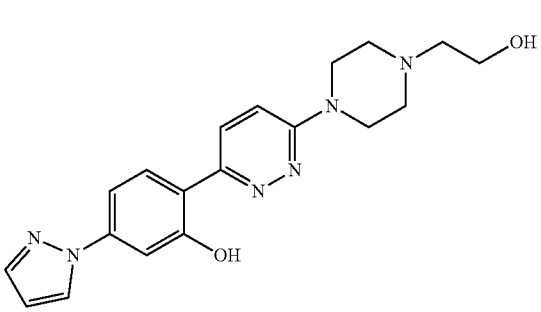
72
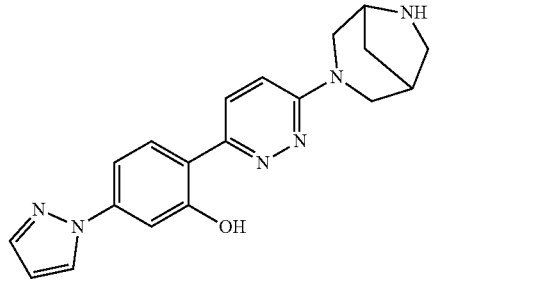
73
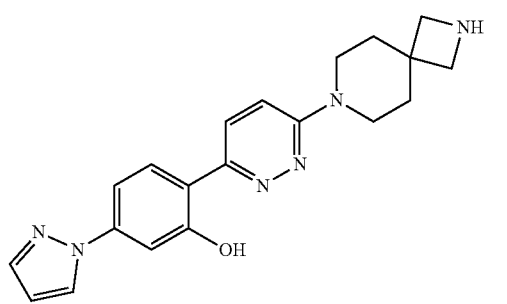

74
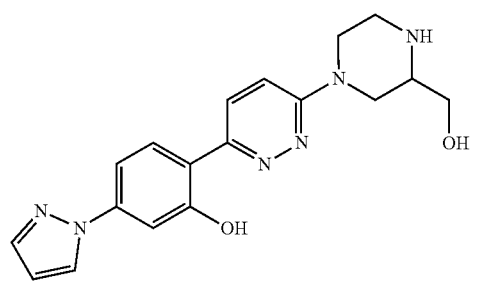
75
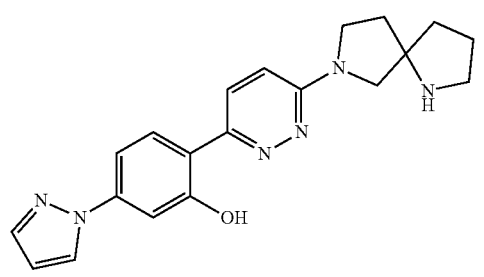
76
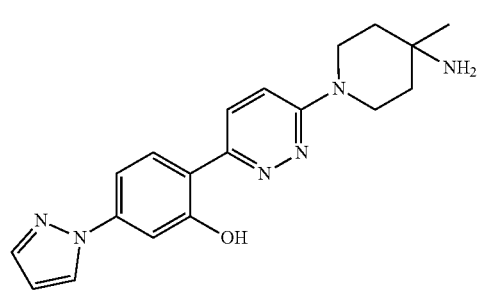
77
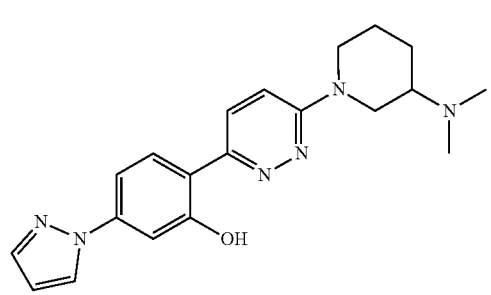
78
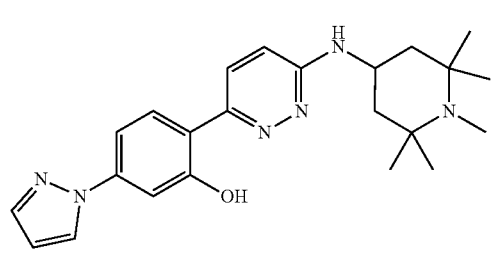
79
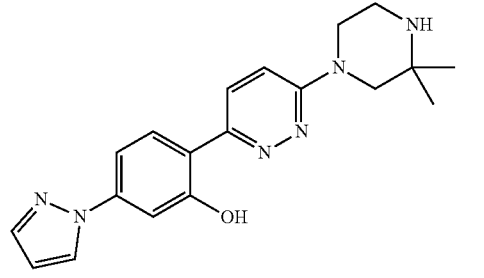
80
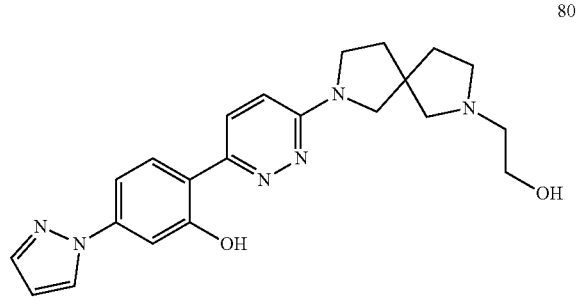
81
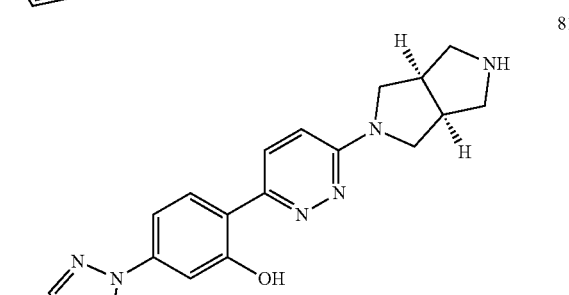
82
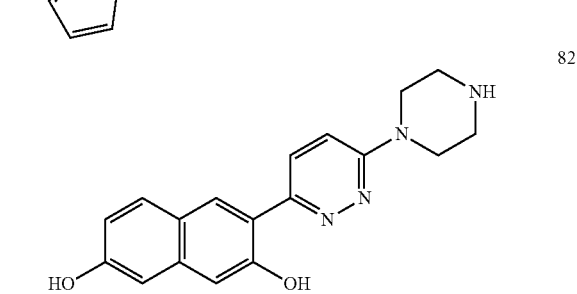
83
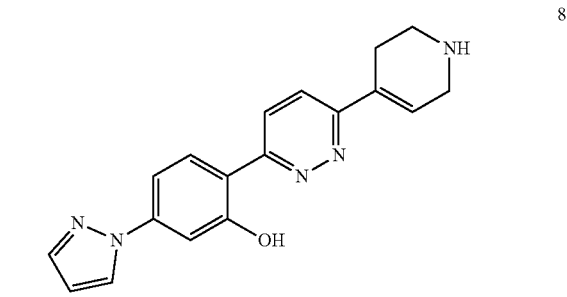
84
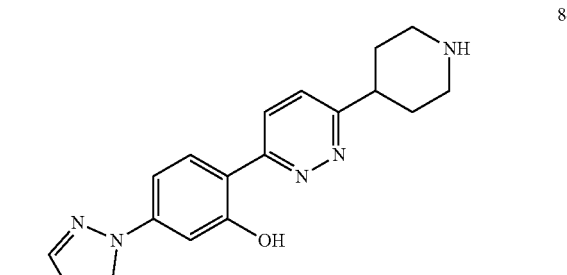
85
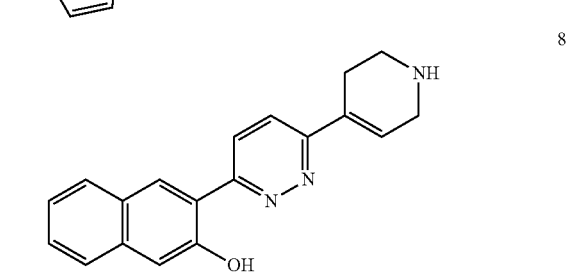

86 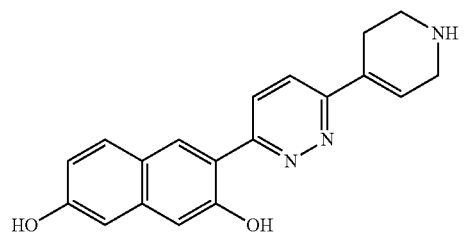
87 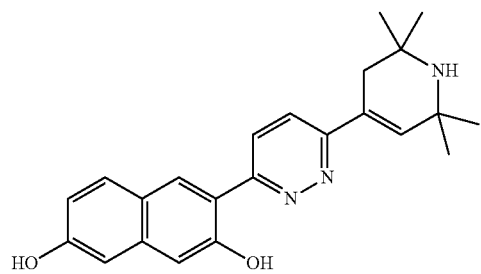
88 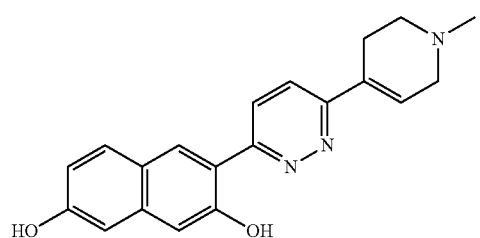
89 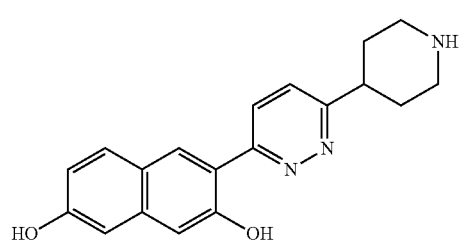
90 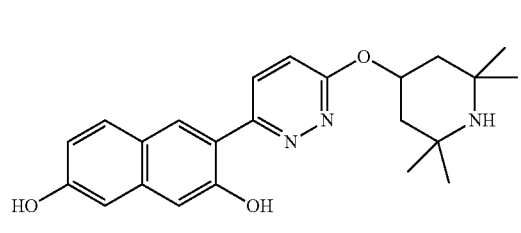
91 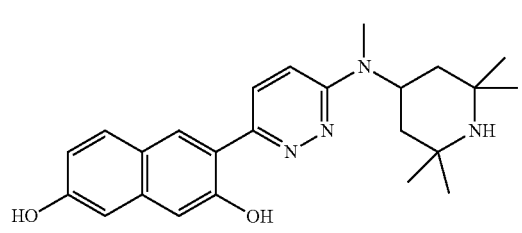
92 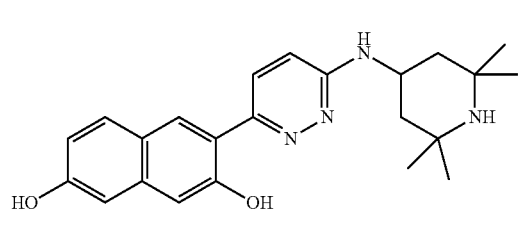
93 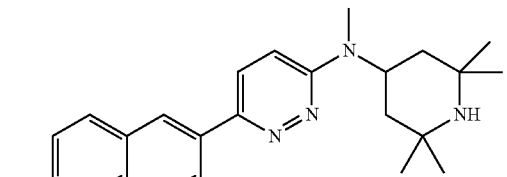
94 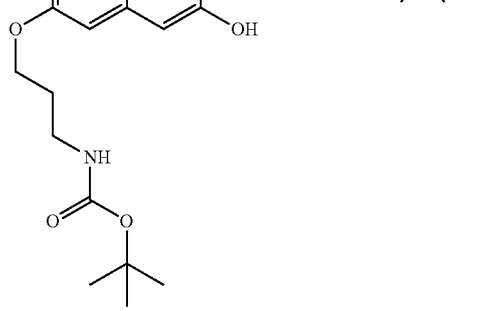
95 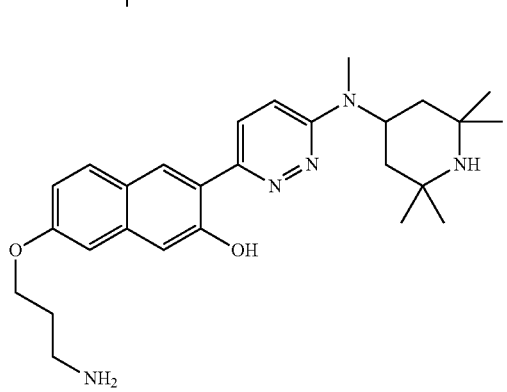
96 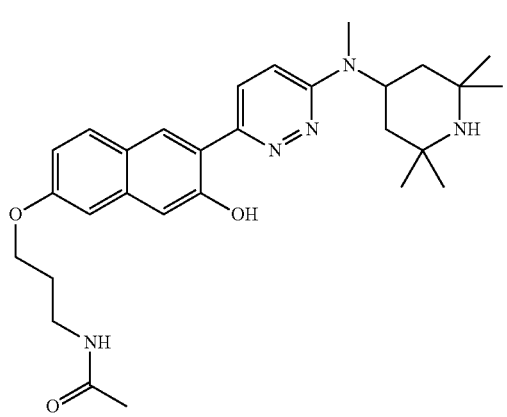
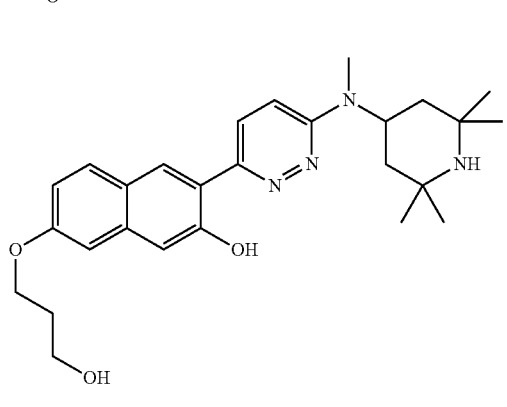

97
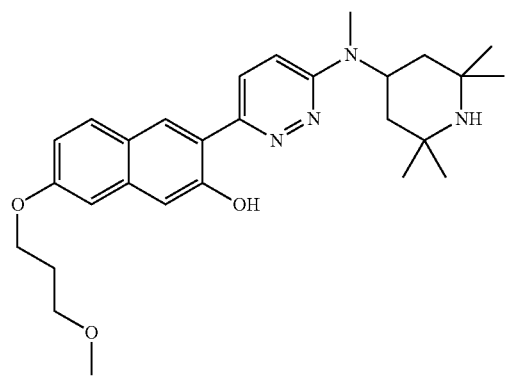
98
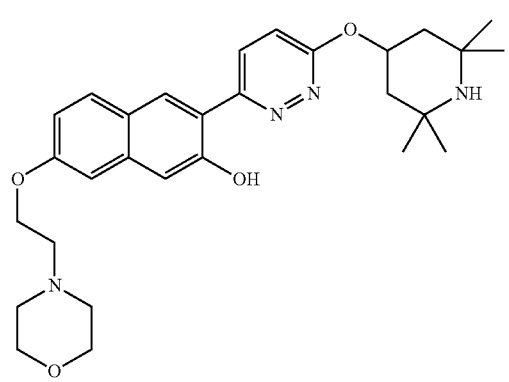
99
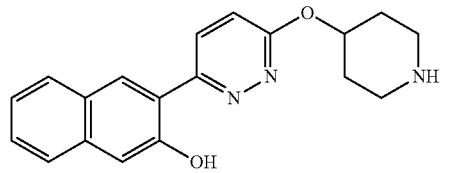
100
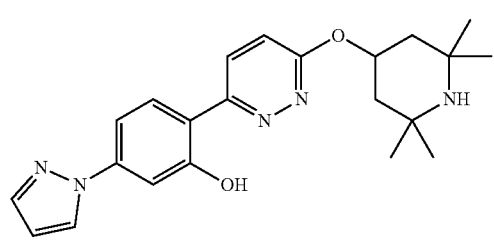
101
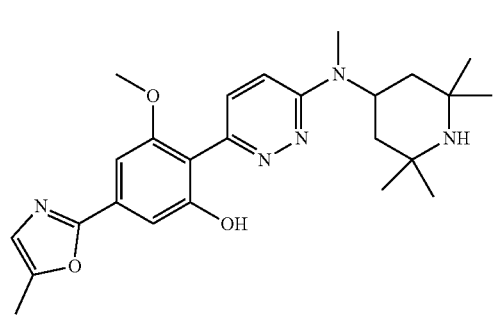
102
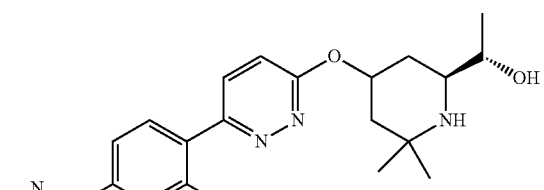
103
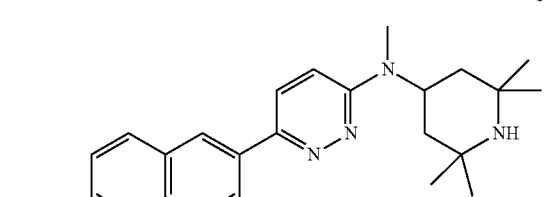
104
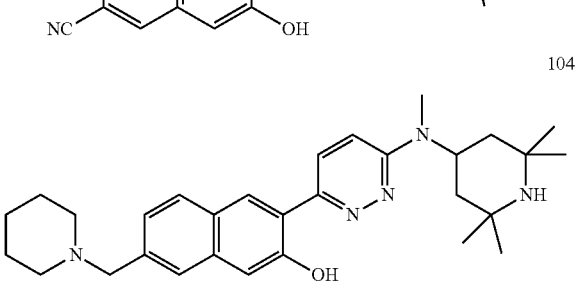
105
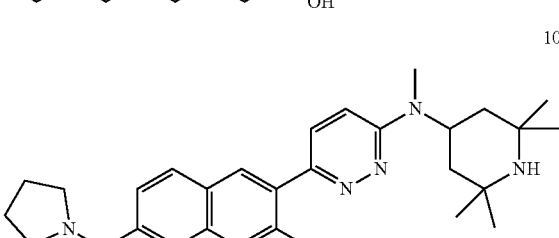
106
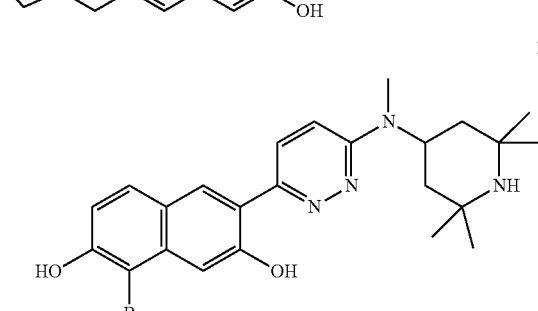
107
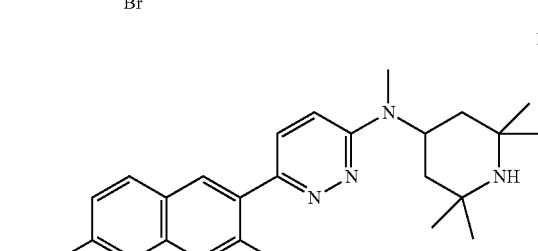
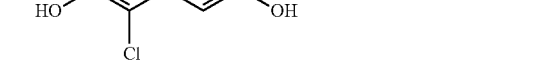

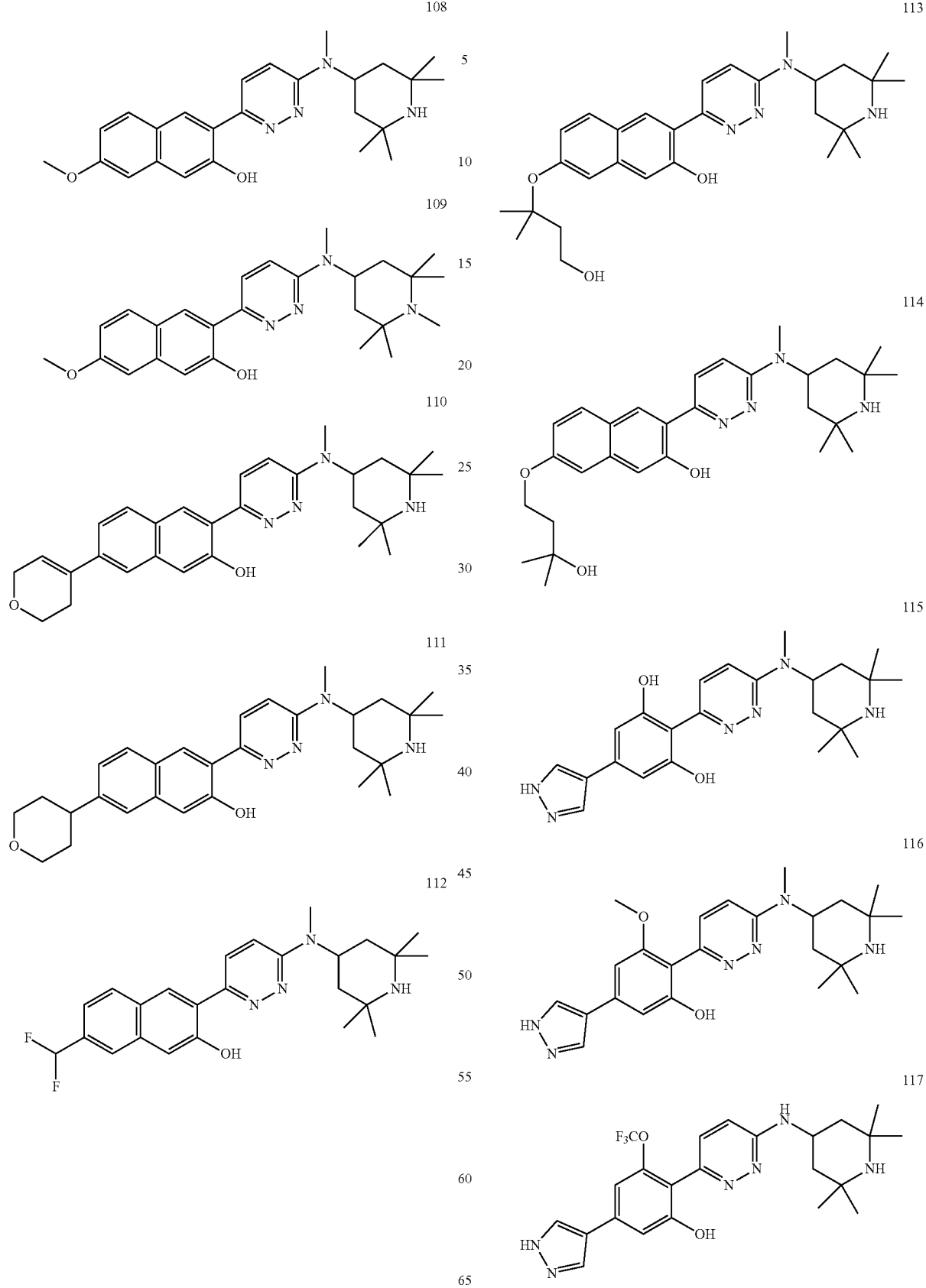

118
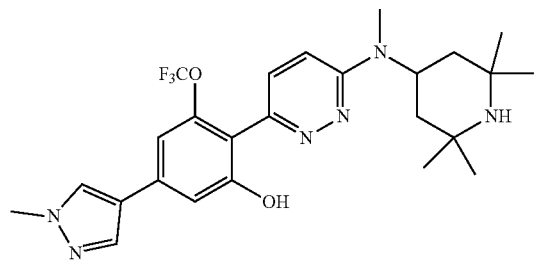
119
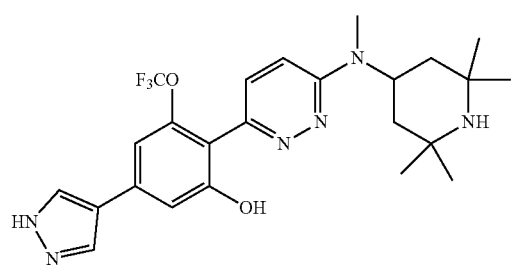
120
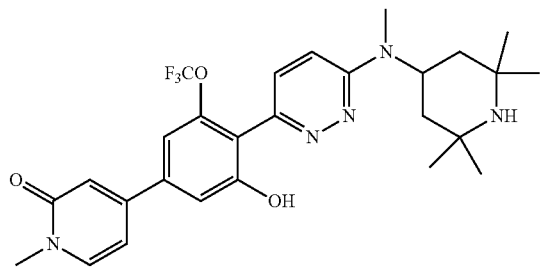
121
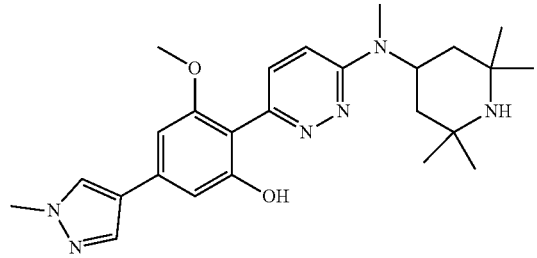
122
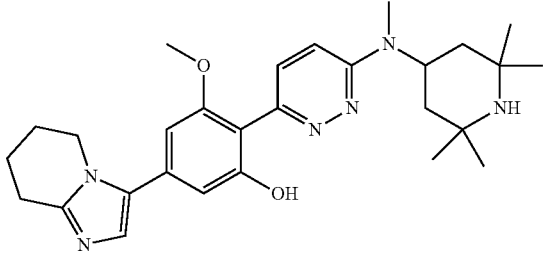
123
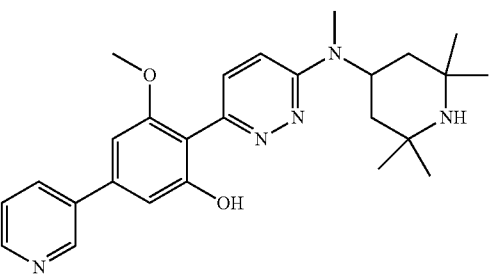
124
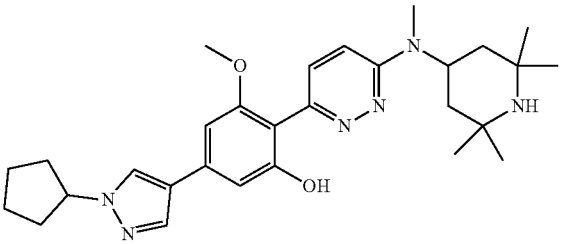
125
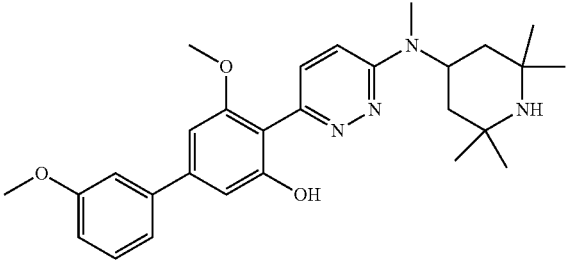
126
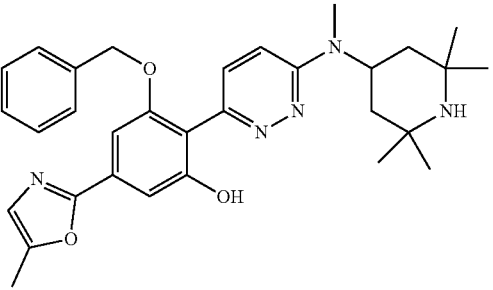
127
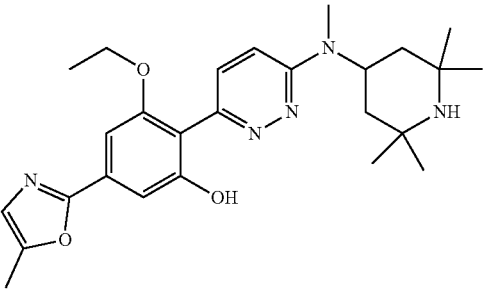

128
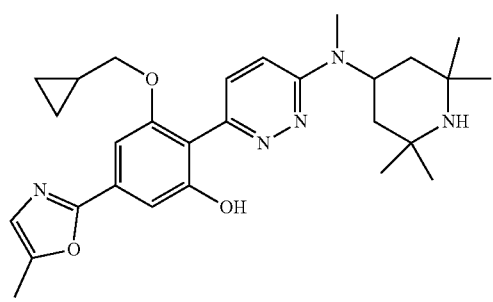
129
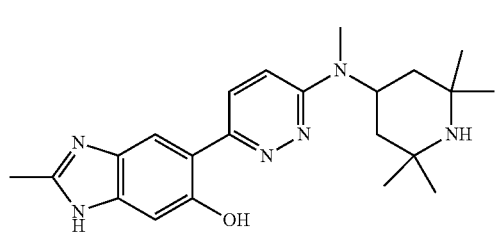
130
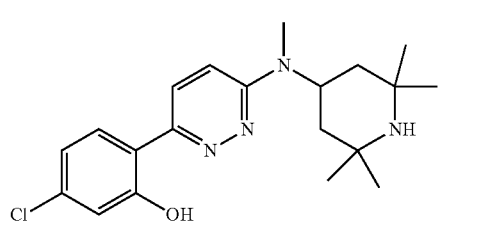
131
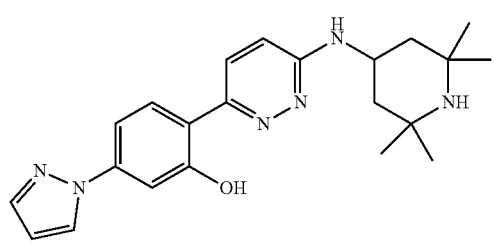
132
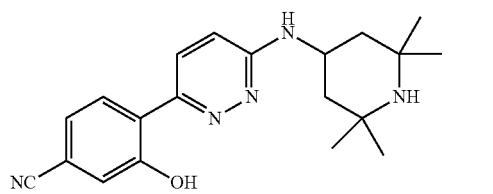
133
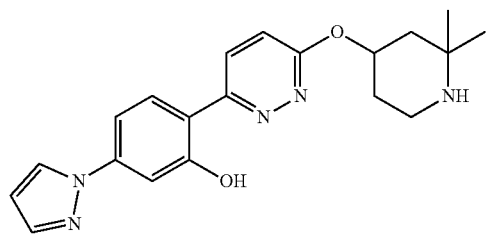
134
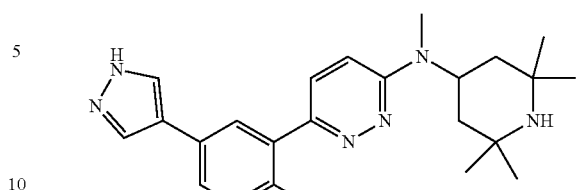
135
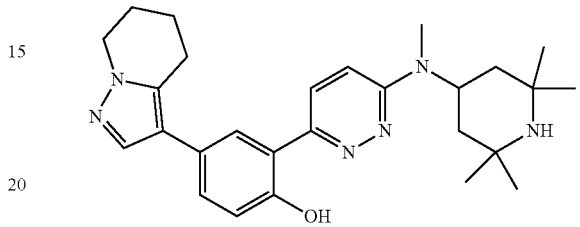
136
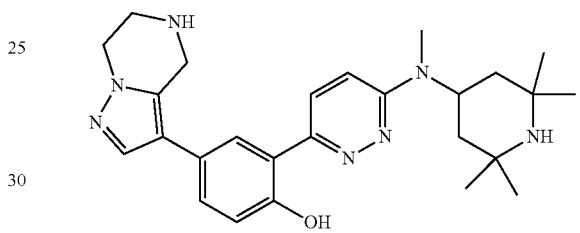
137
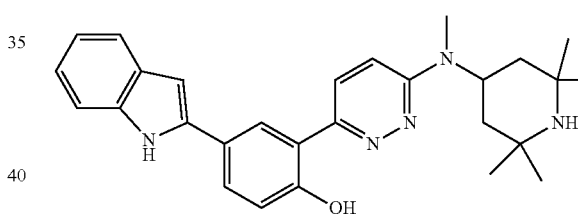
138
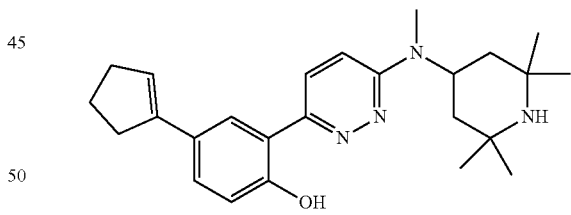
139
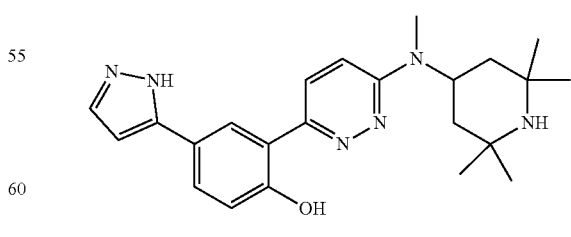

140
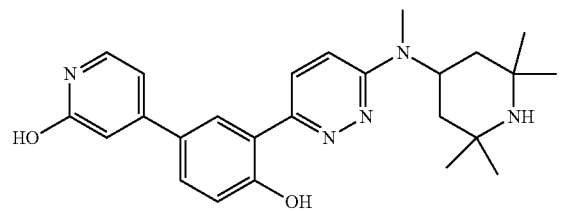
141
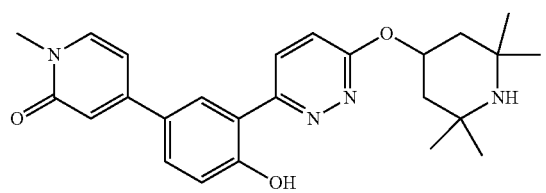
142
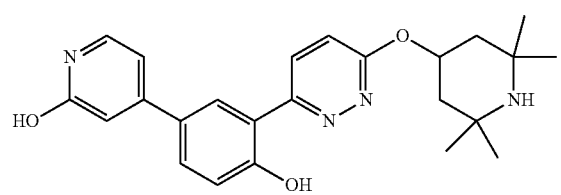
143
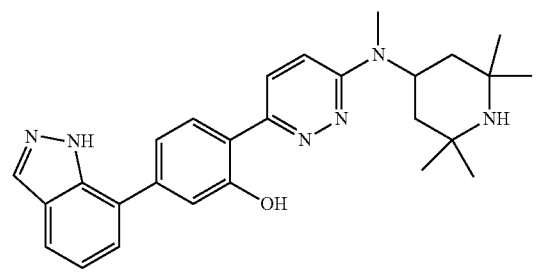
144
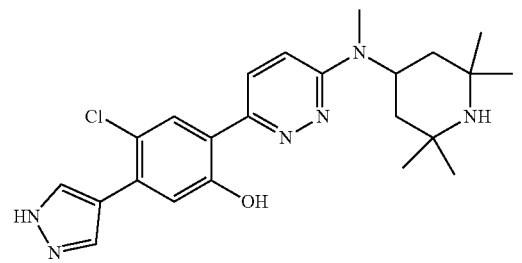
145
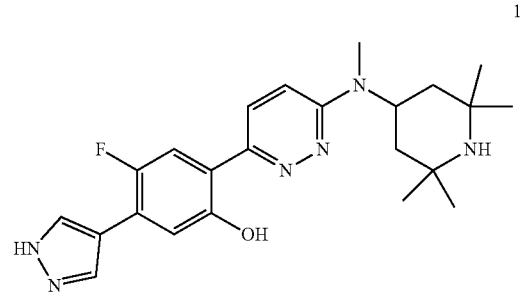
146
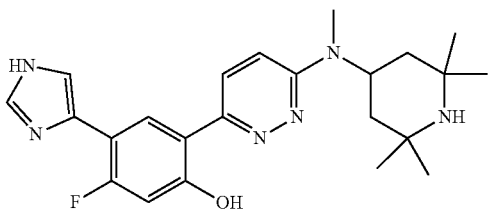
147
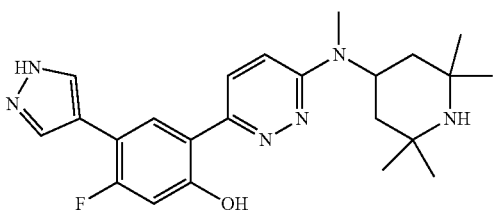
148
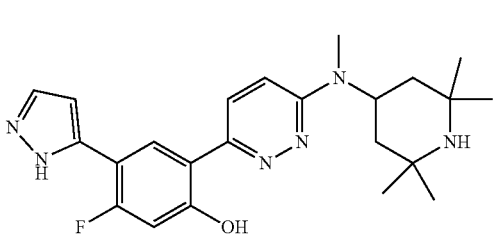
149
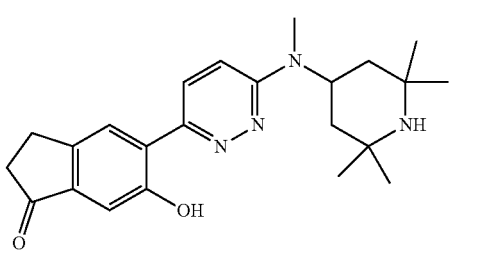
150
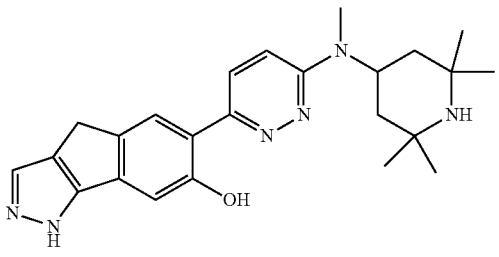
151
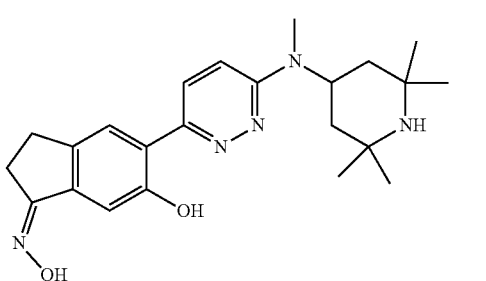

152
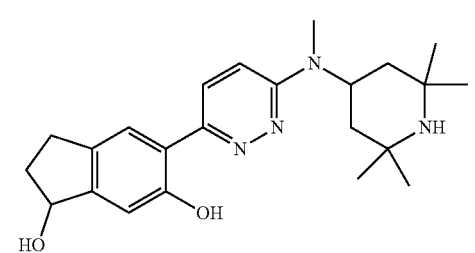
153
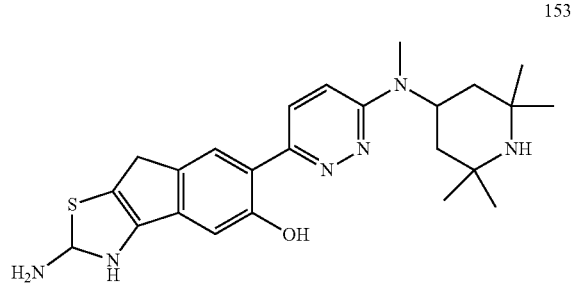
154
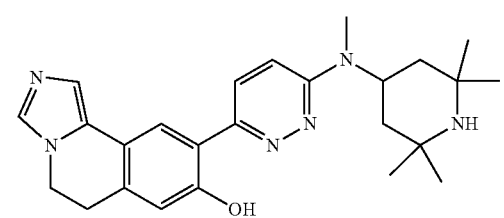
155
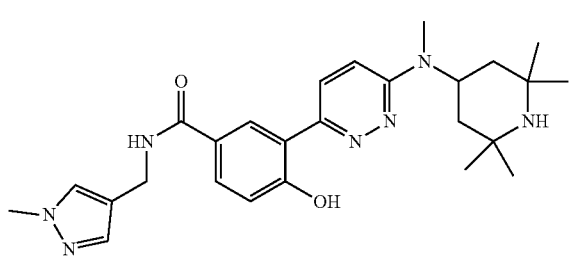
156
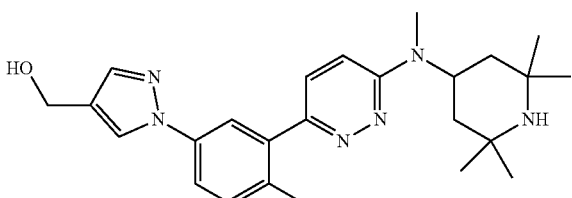
157
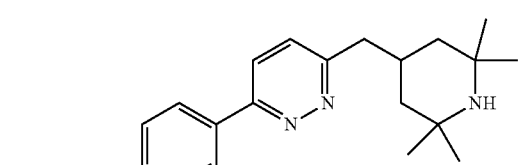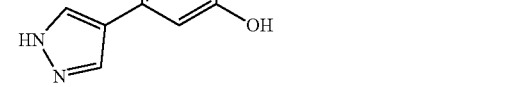
158
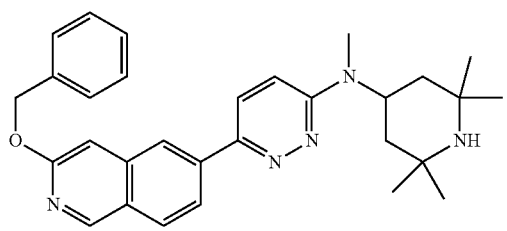
159
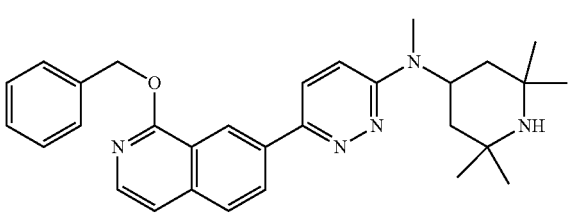
160
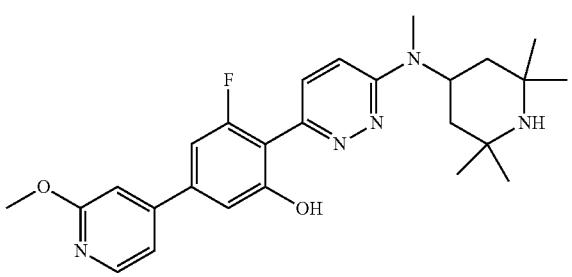
161
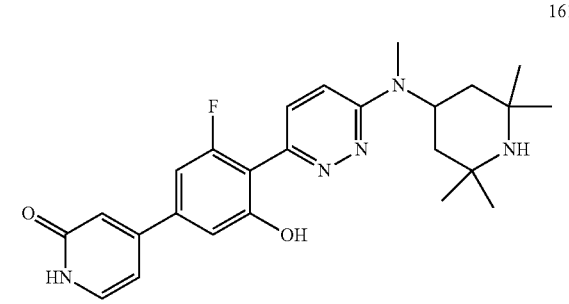
162
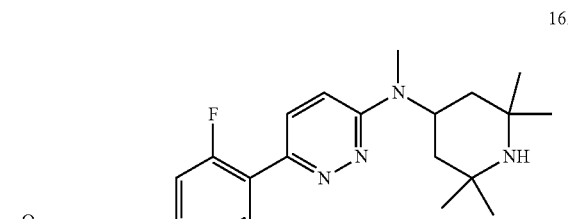

-continued
163
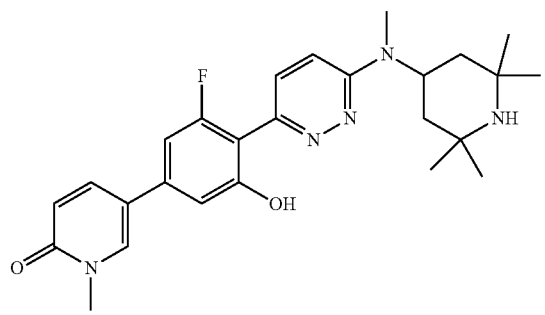
164
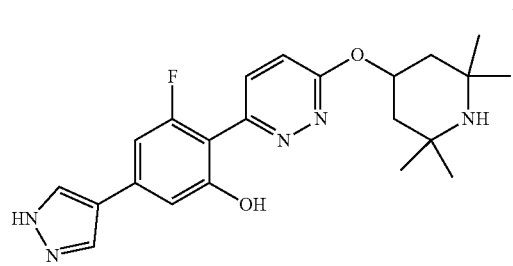
165
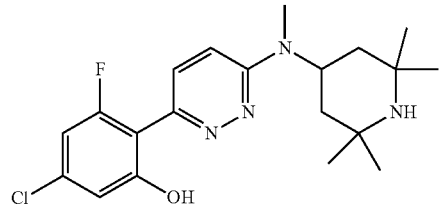
166
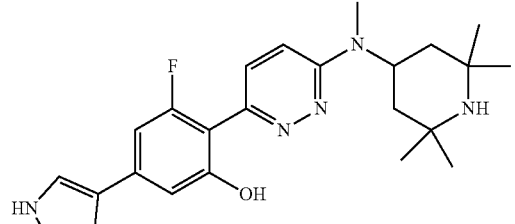
167
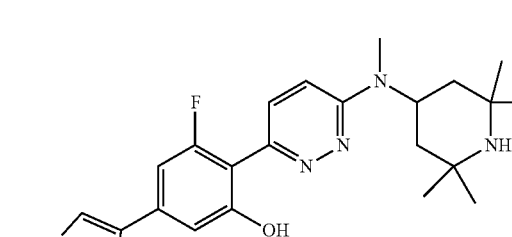
-continued
168
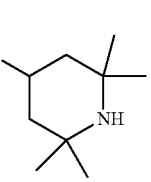
169
170
171
172

173
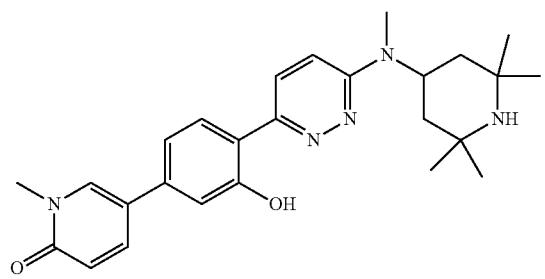
174
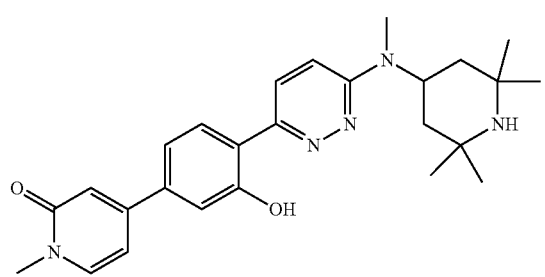
175
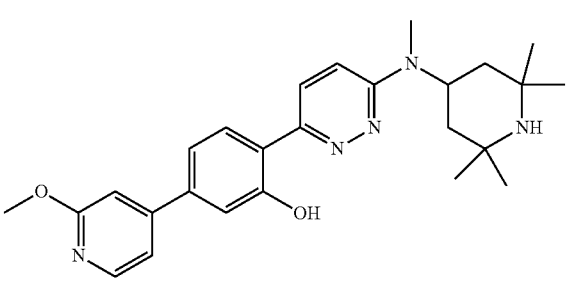
176
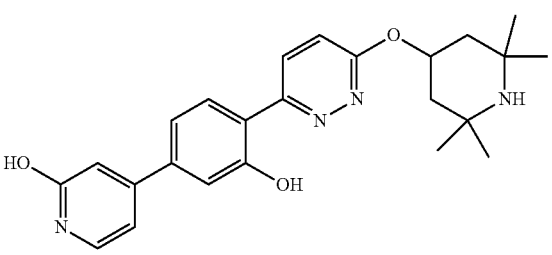
177
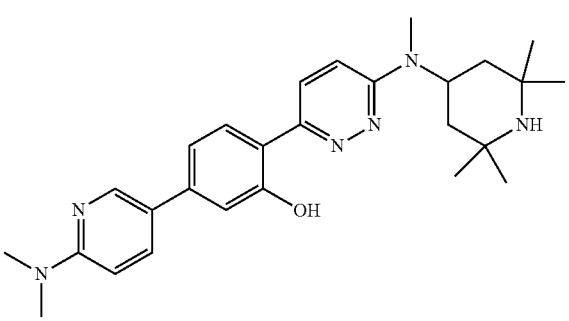
178
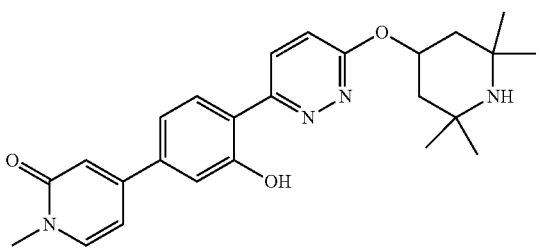
179
180
181
182
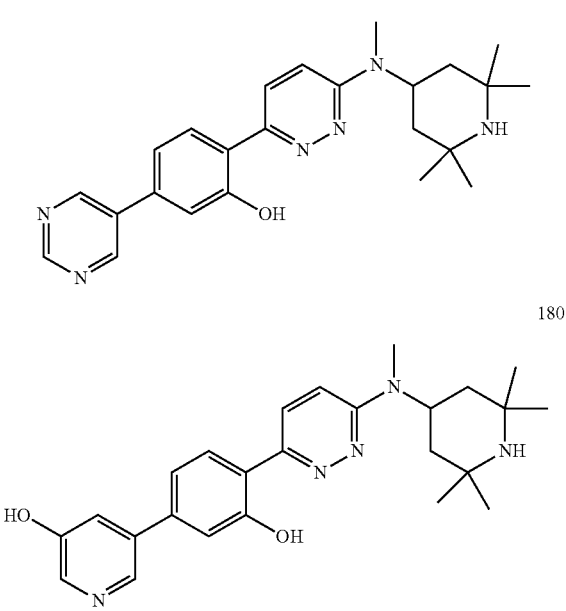

183
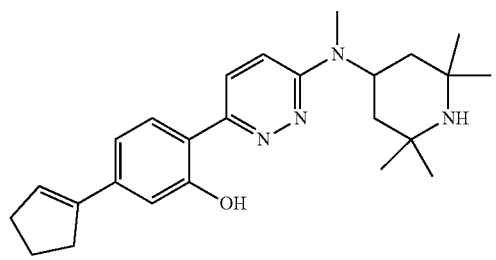
184
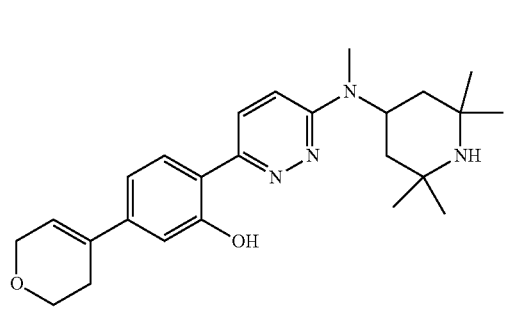
185
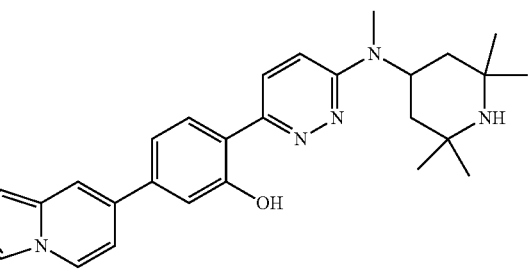
186
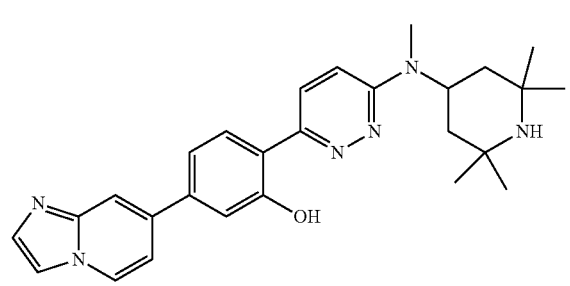
187
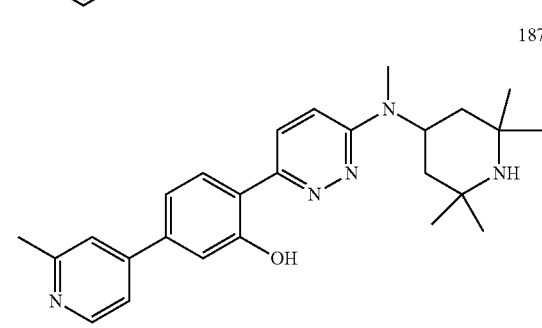
188
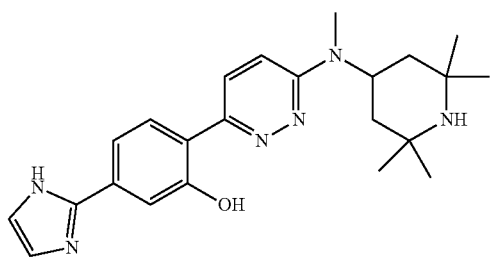
189
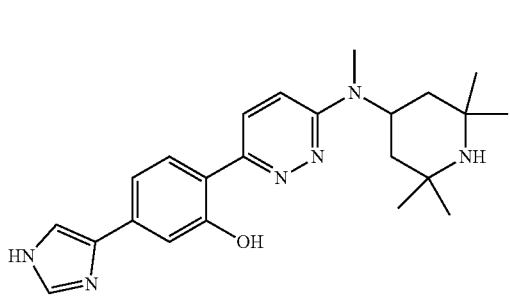
190
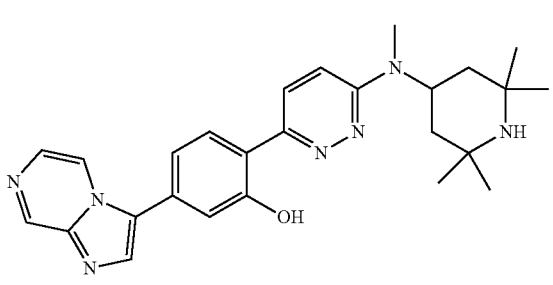
191
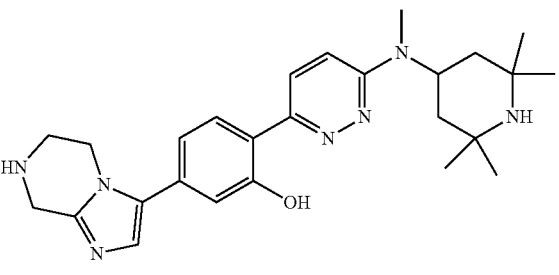
192
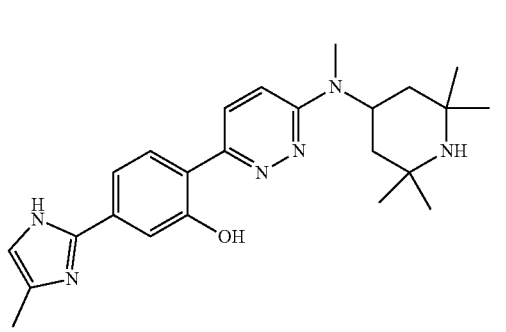

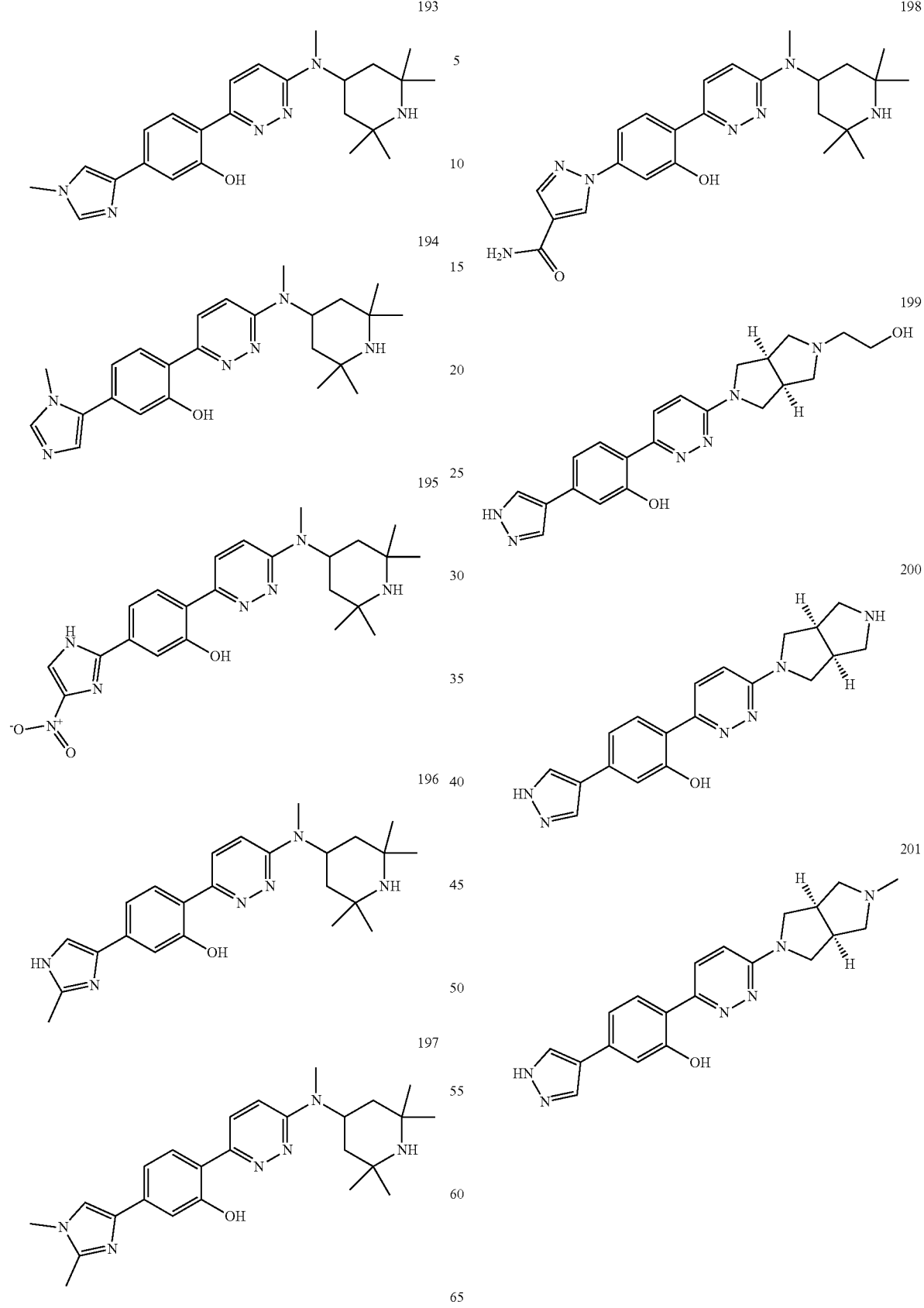

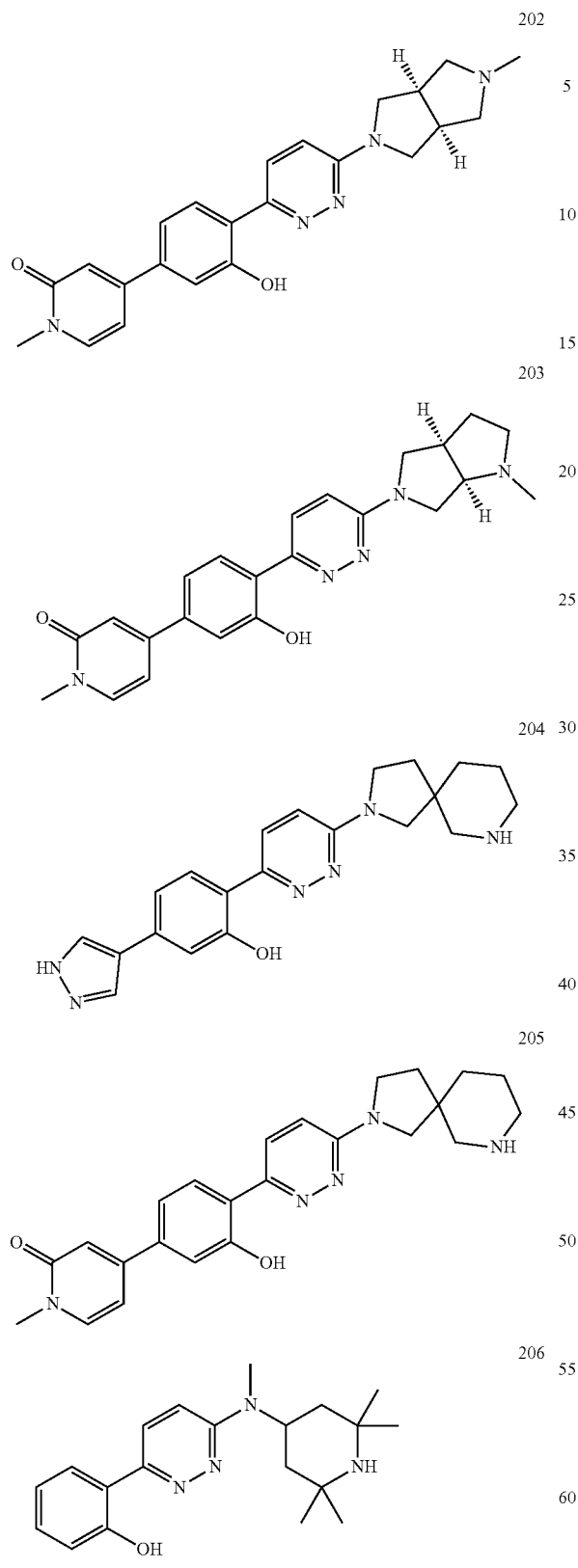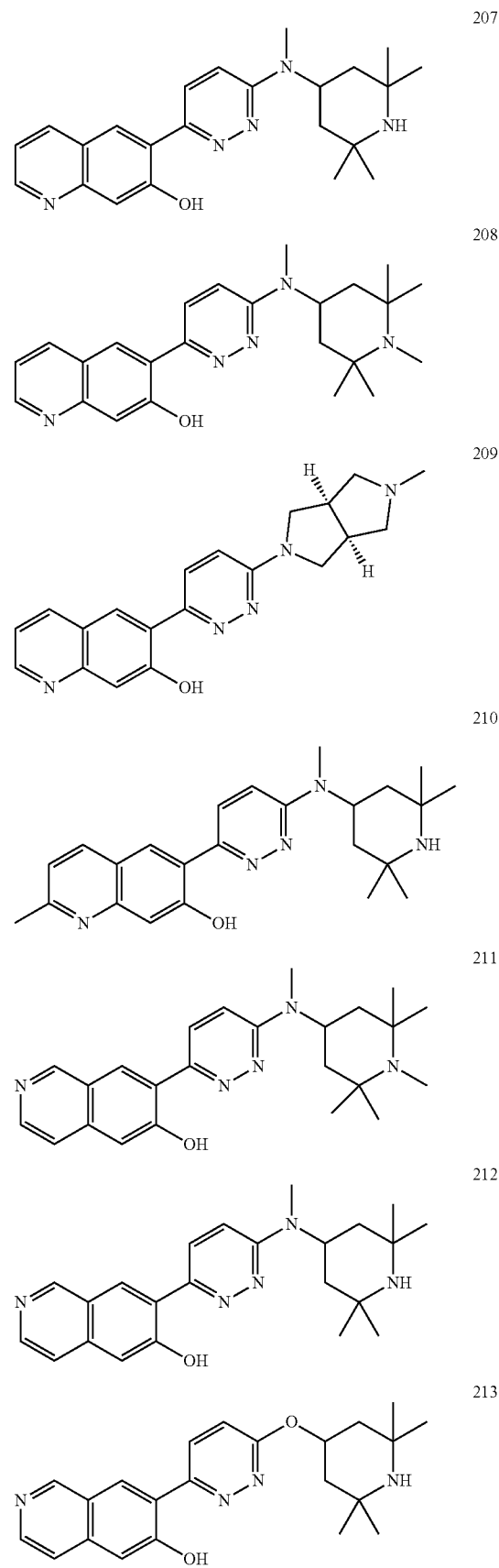

229 -continued
214 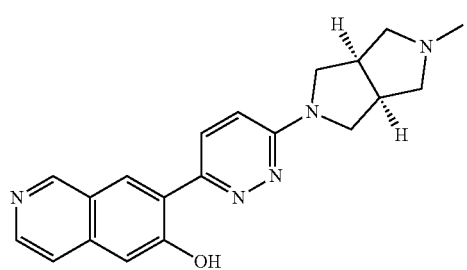
215 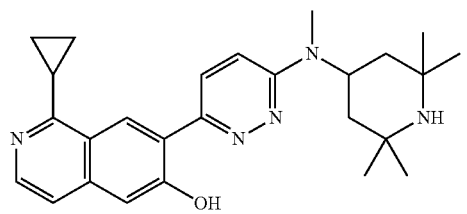
216 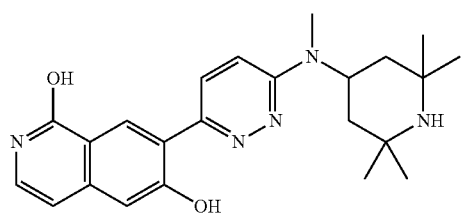
217 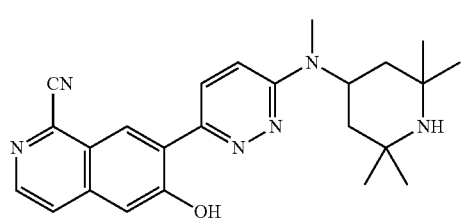
218 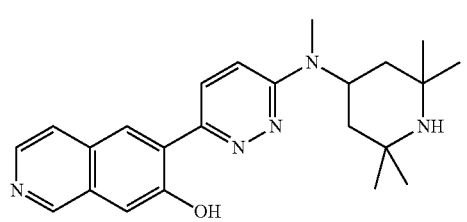
219 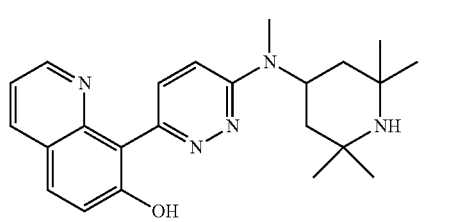
220 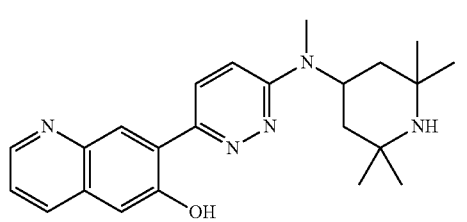
230 -continued
221 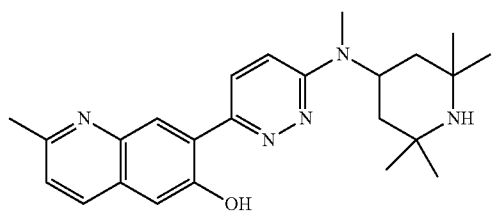
222 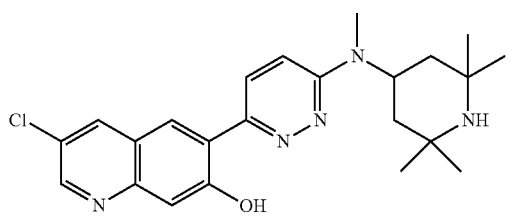
223 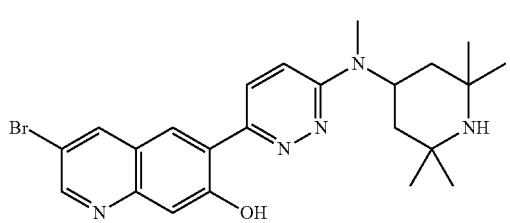
224 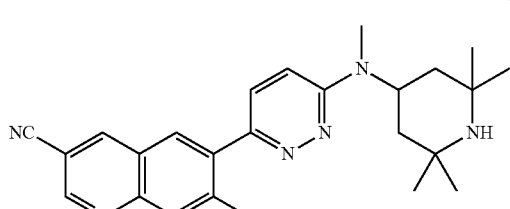
225 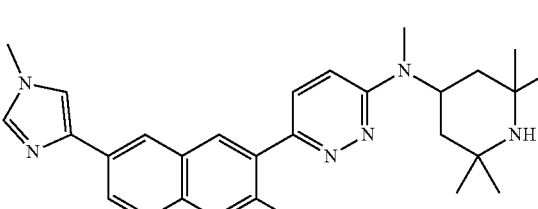
226 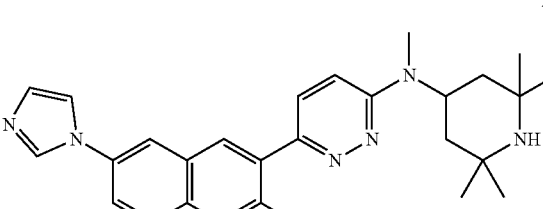

-continued
227
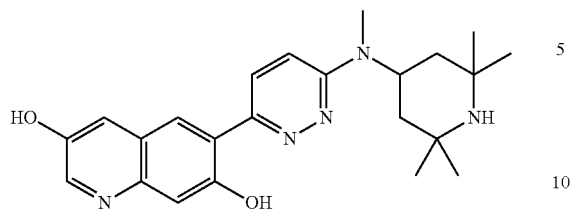
228
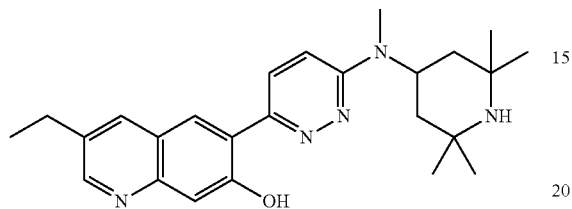
229
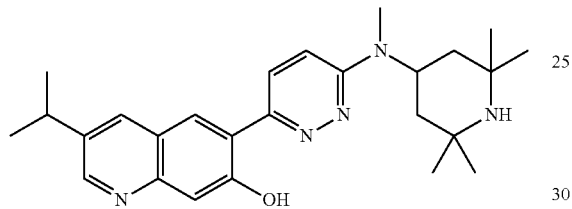
230
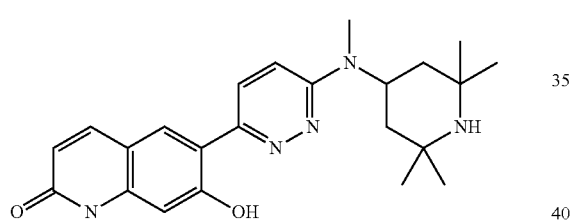
231
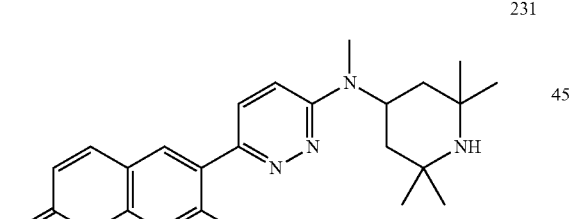
232
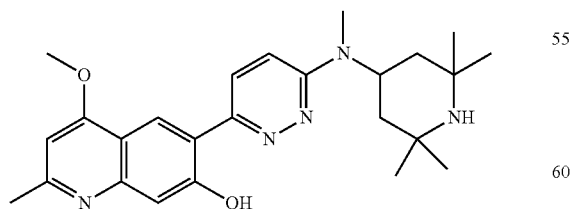
-continued
233
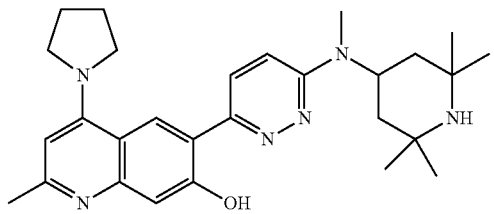
234
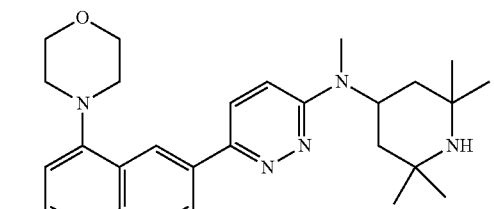
235
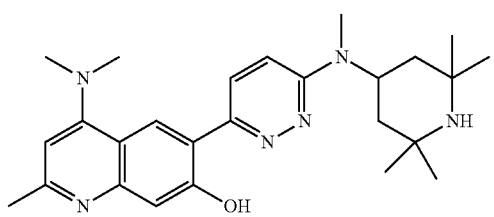
236
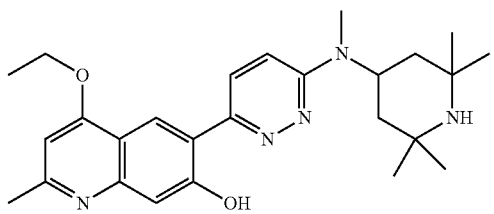
237
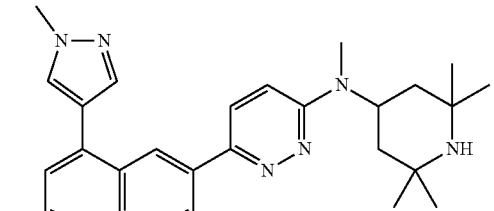
238
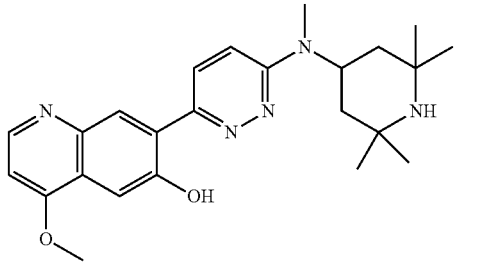

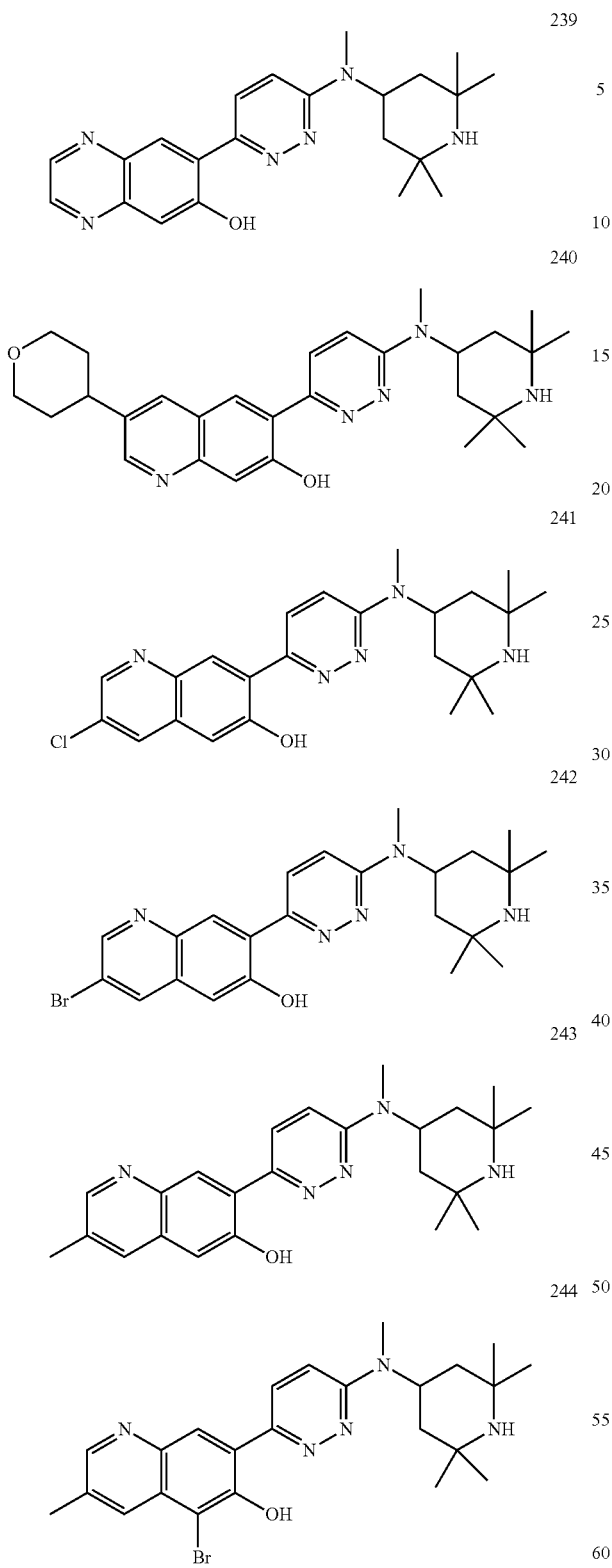
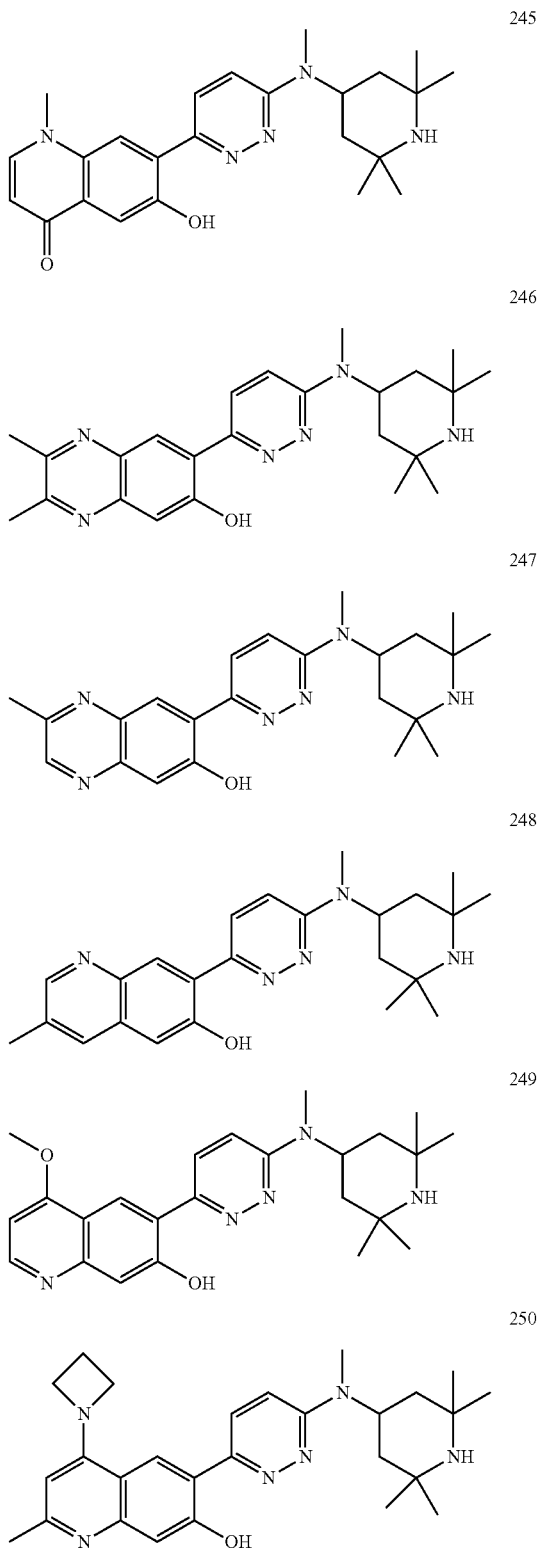

251 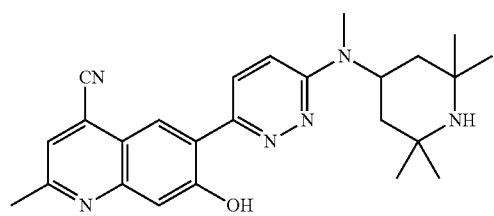
252 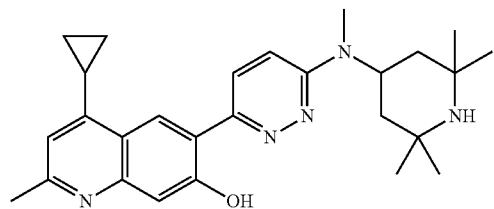
253 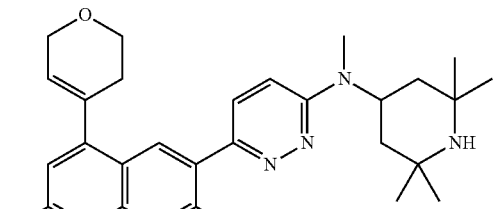
254 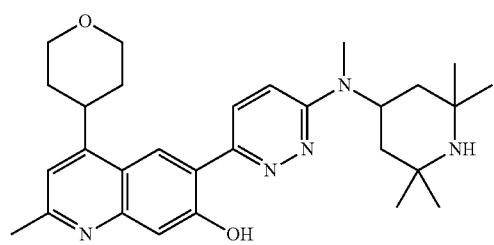
255 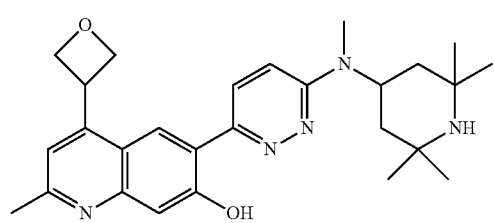
256 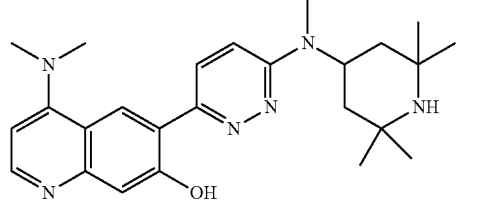
257 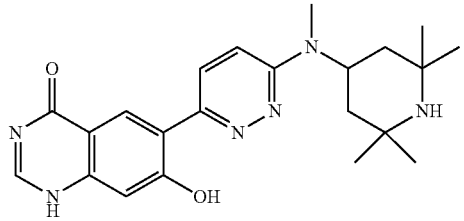
258 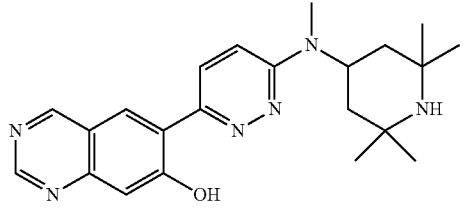
259 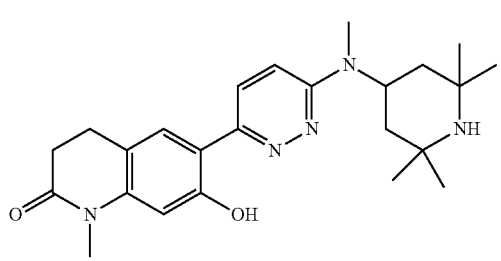
260 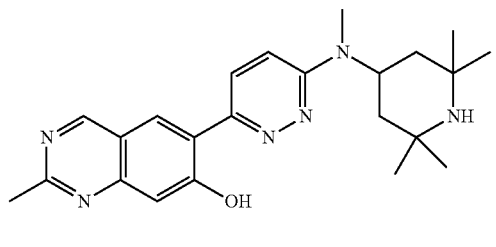
261 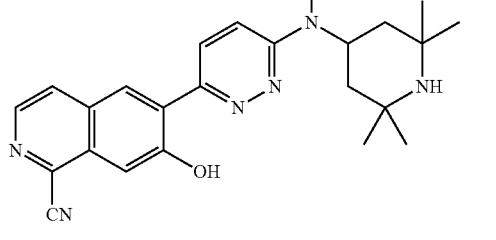
262 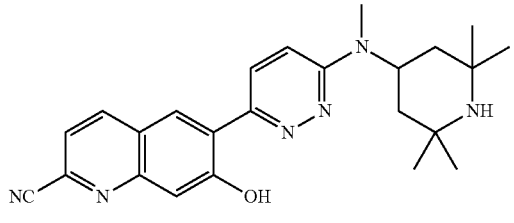

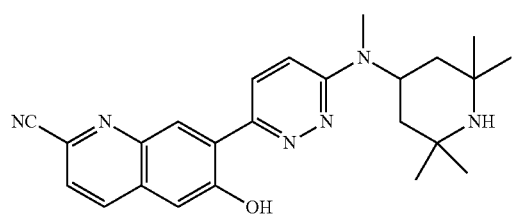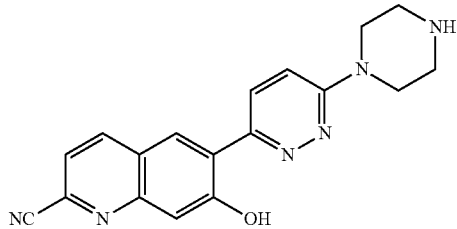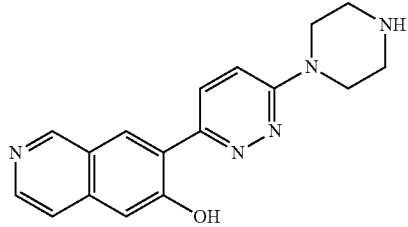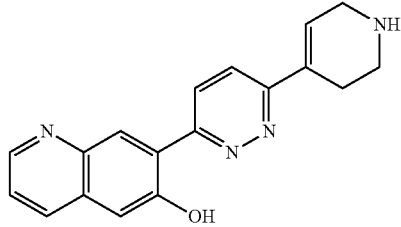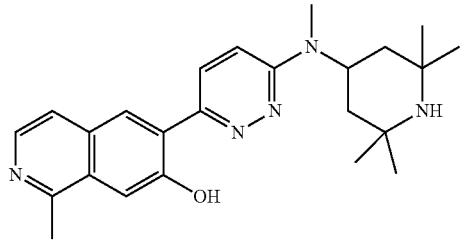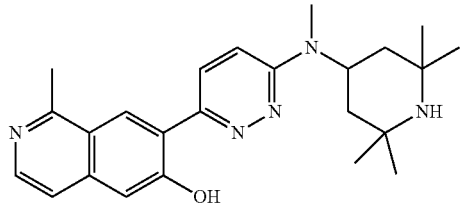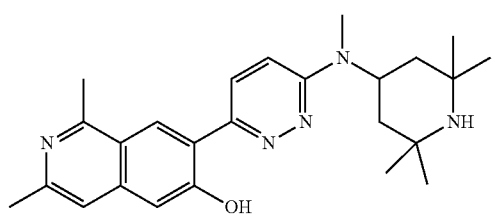

275 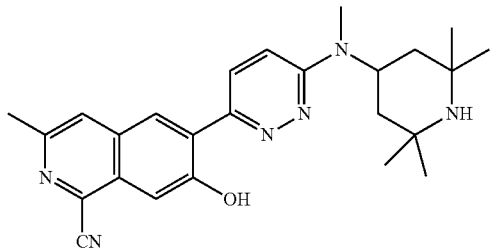
276 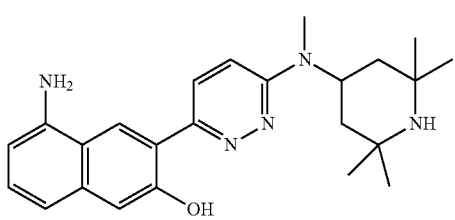
277 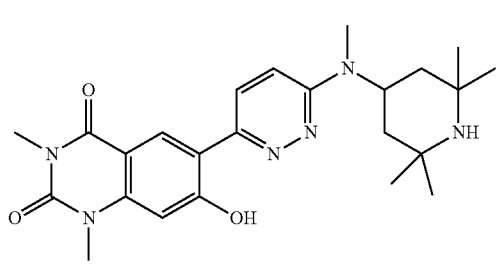
278 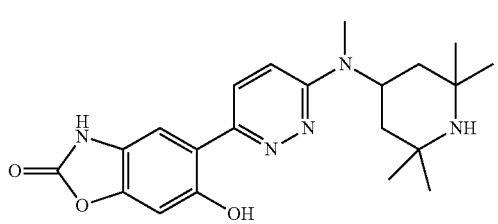
279 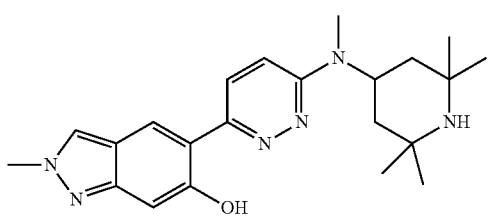
280 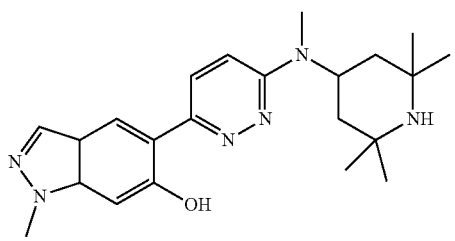
281 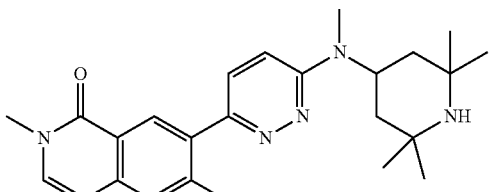
282 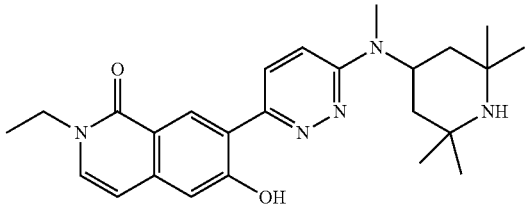
283 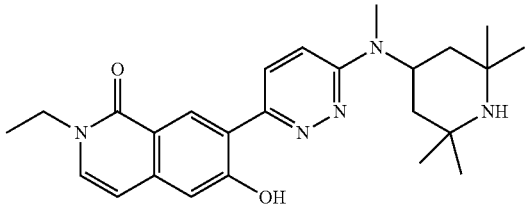
284 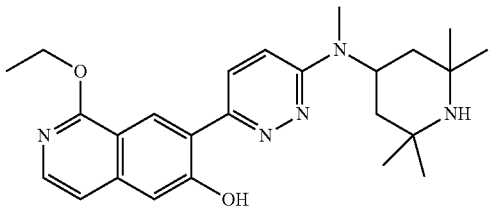
285 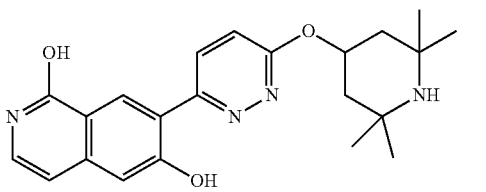
286 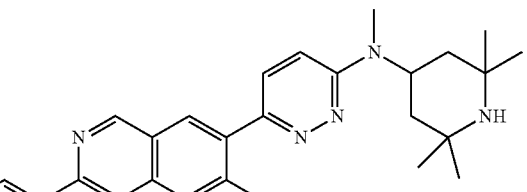

287
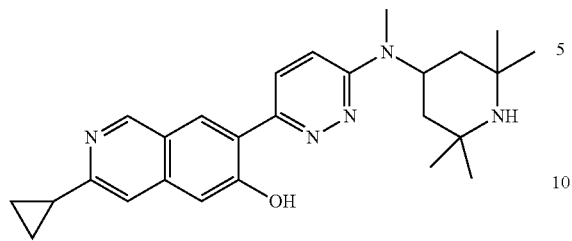
288
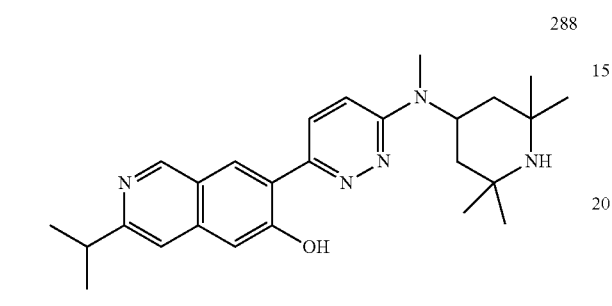
289
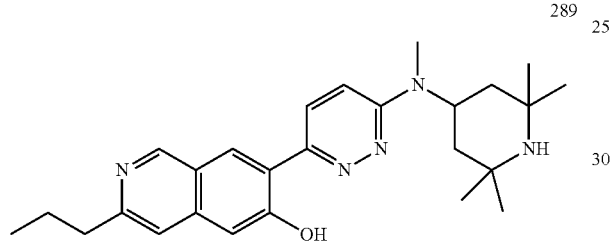
290
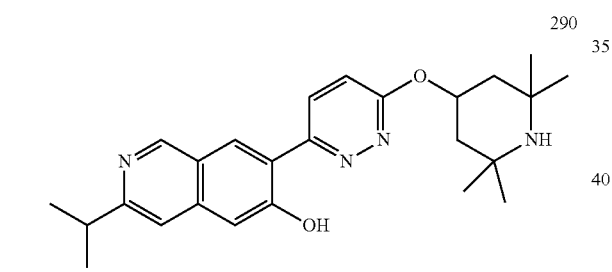
291
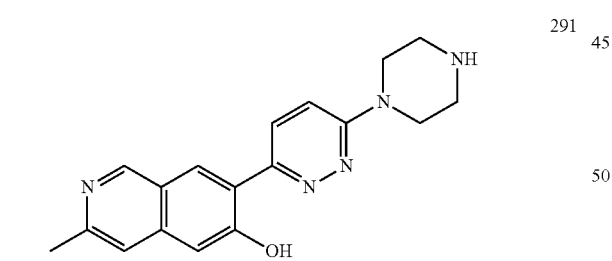
292
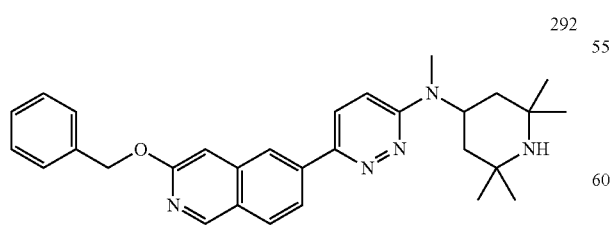
293
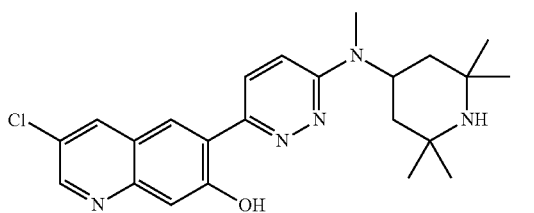
294
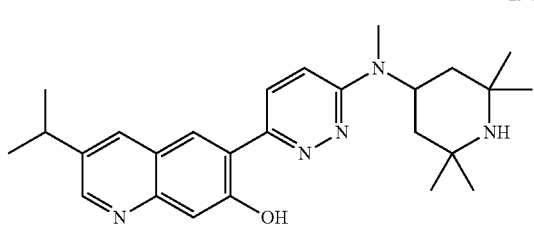
295
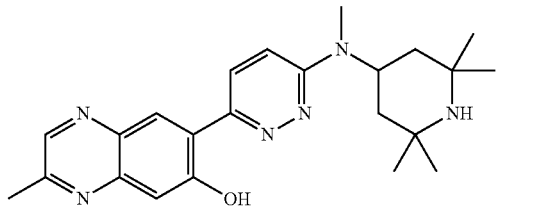
296
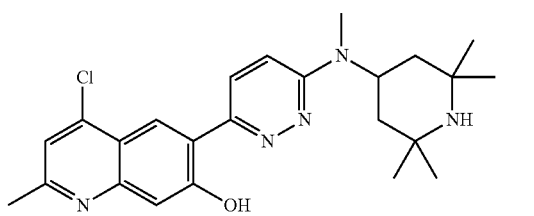
297
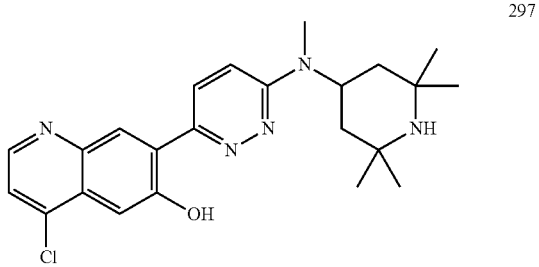
300

301 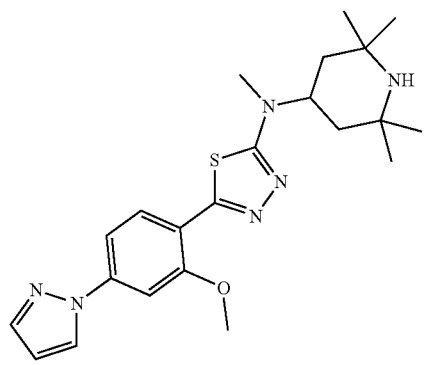
302 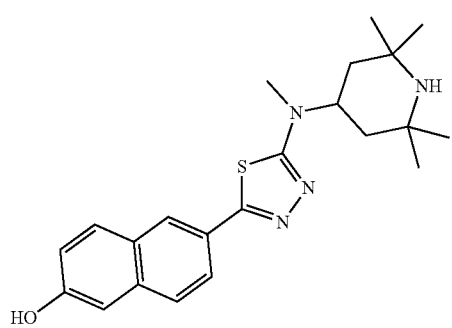
303 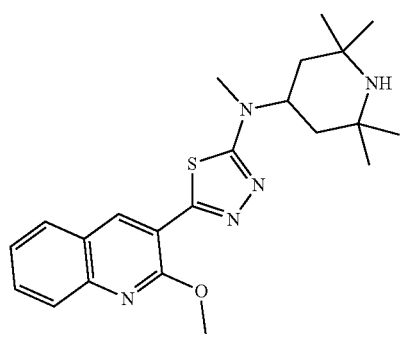
304 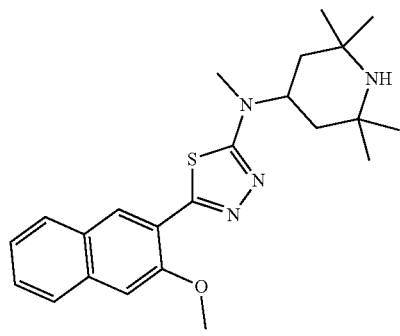
305 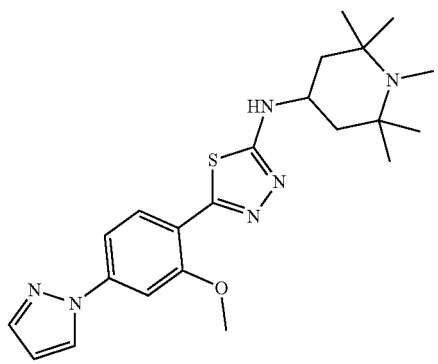
306 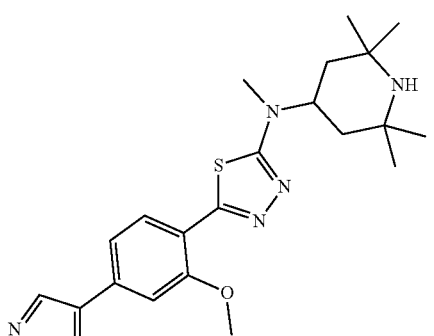
307 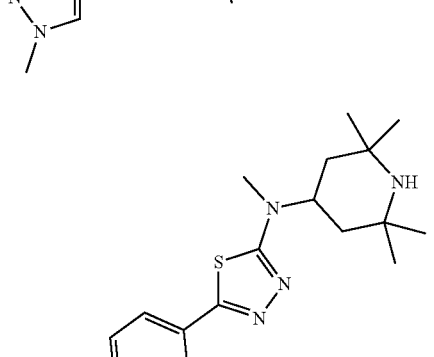
308 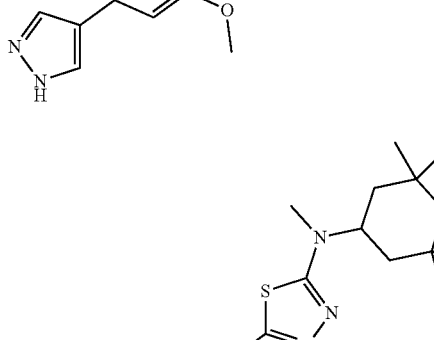

309
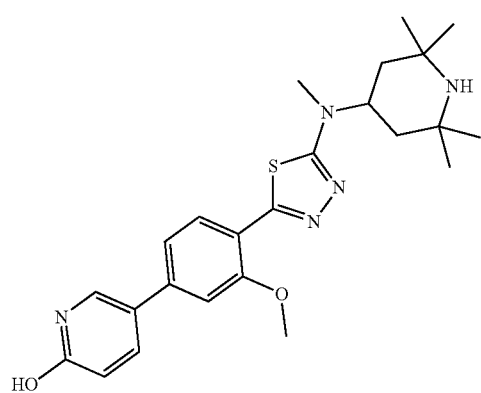
310
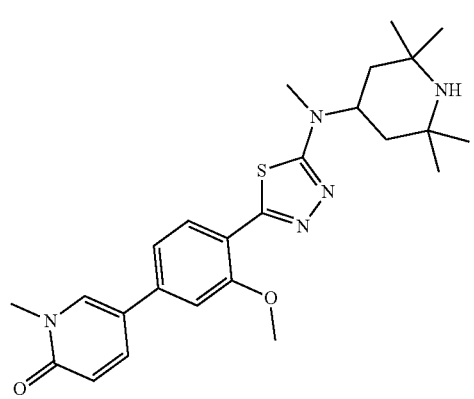
311
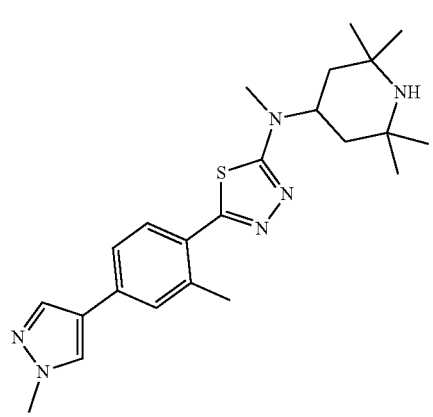
312
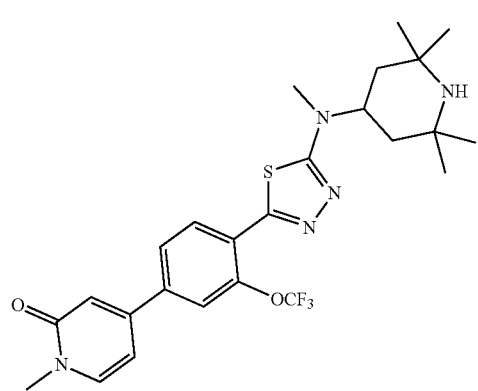
313
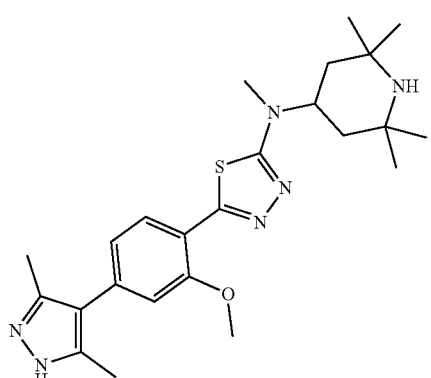
314
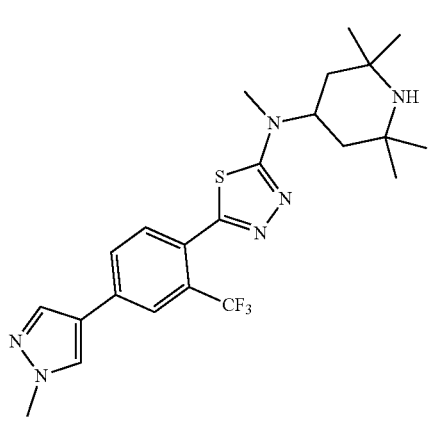
315
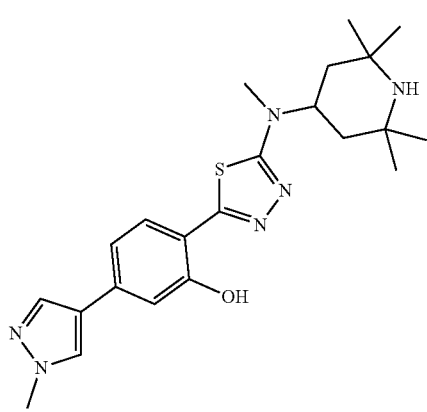
316
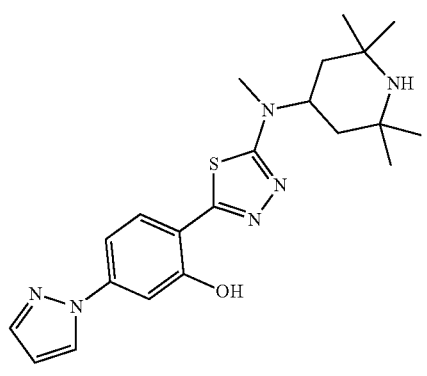

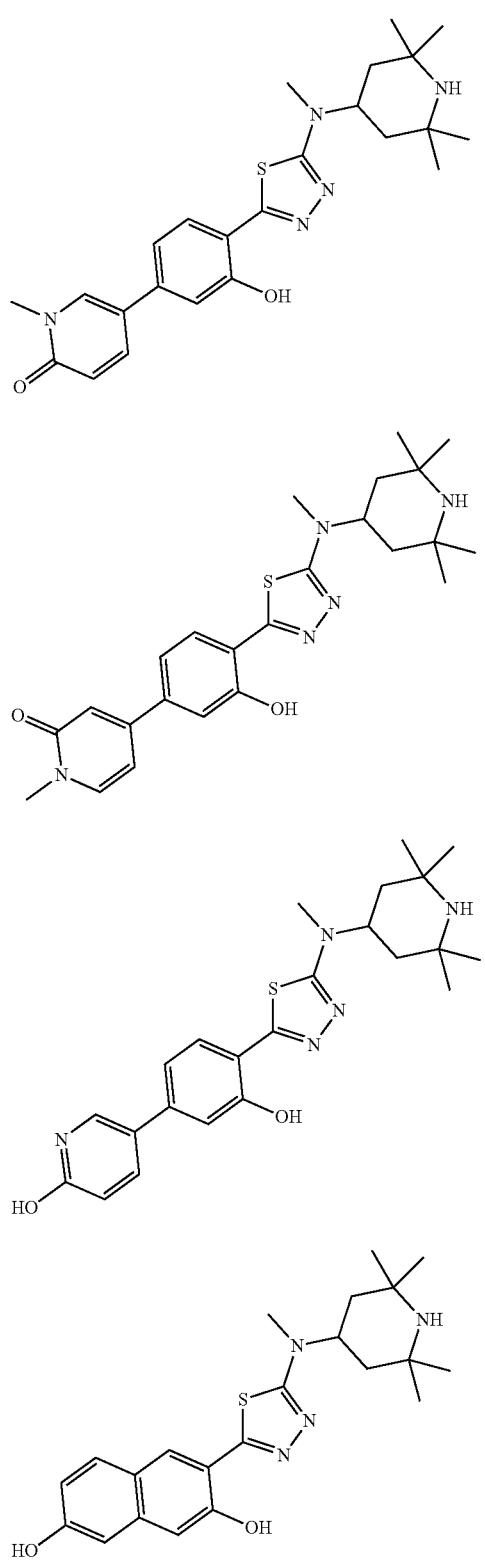
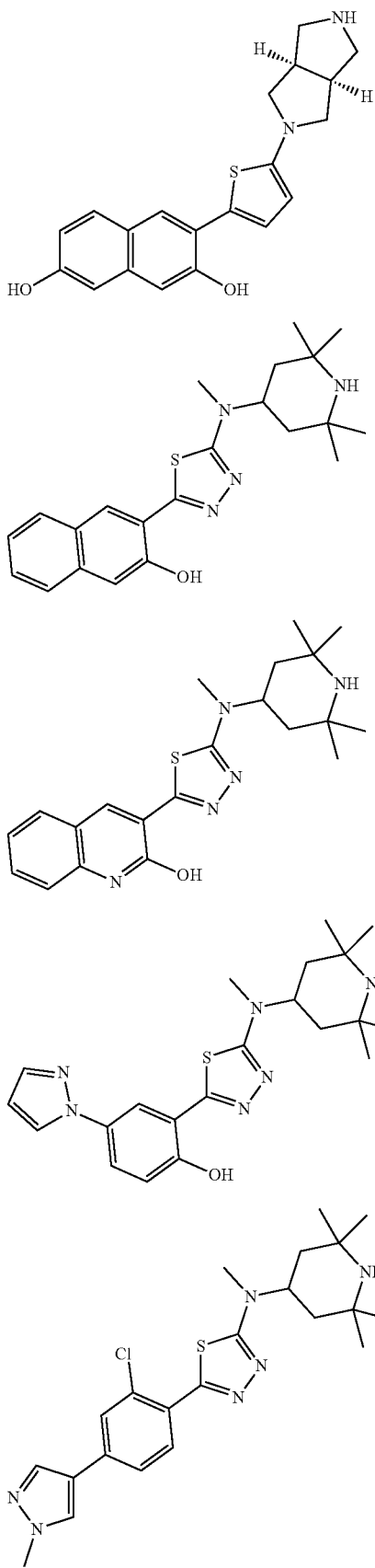

326 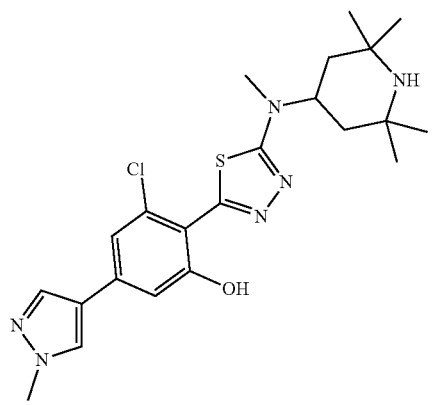
327 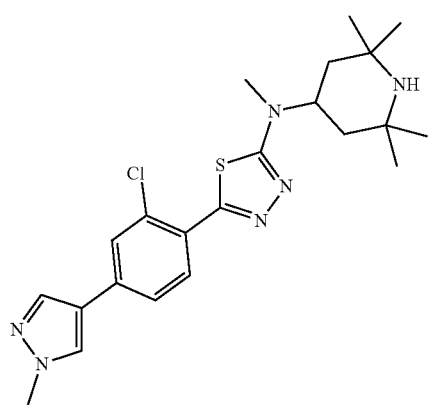
328 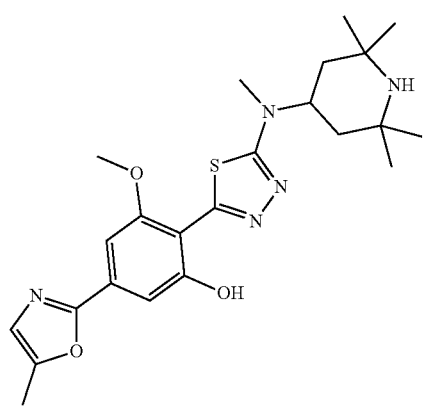
329 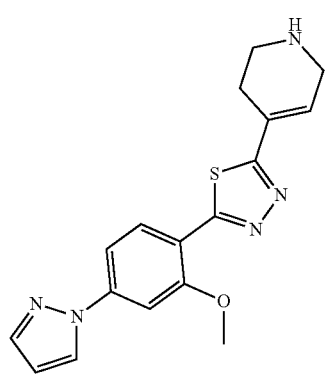
330 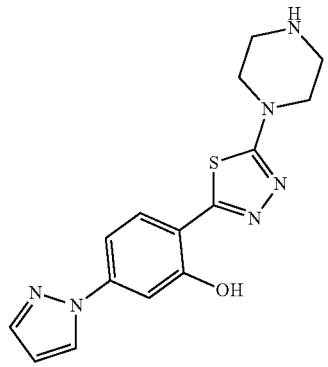
331 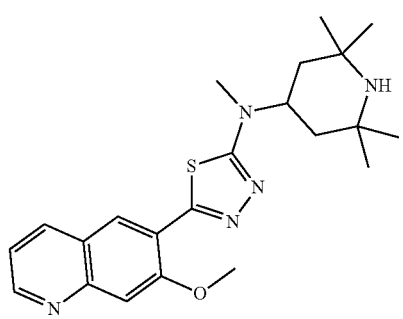
332 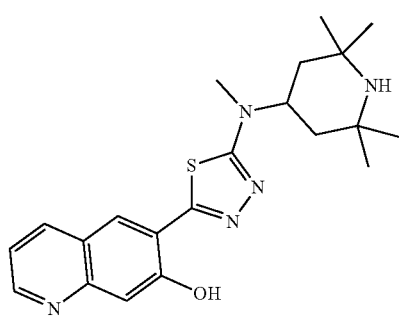
333 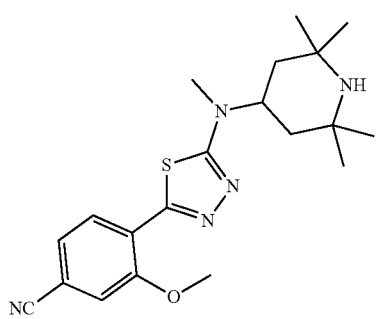
334 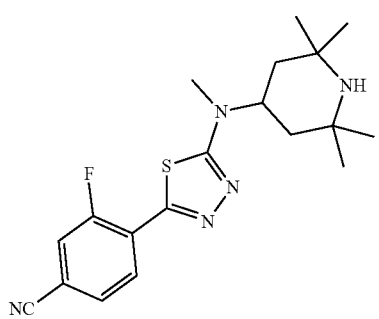

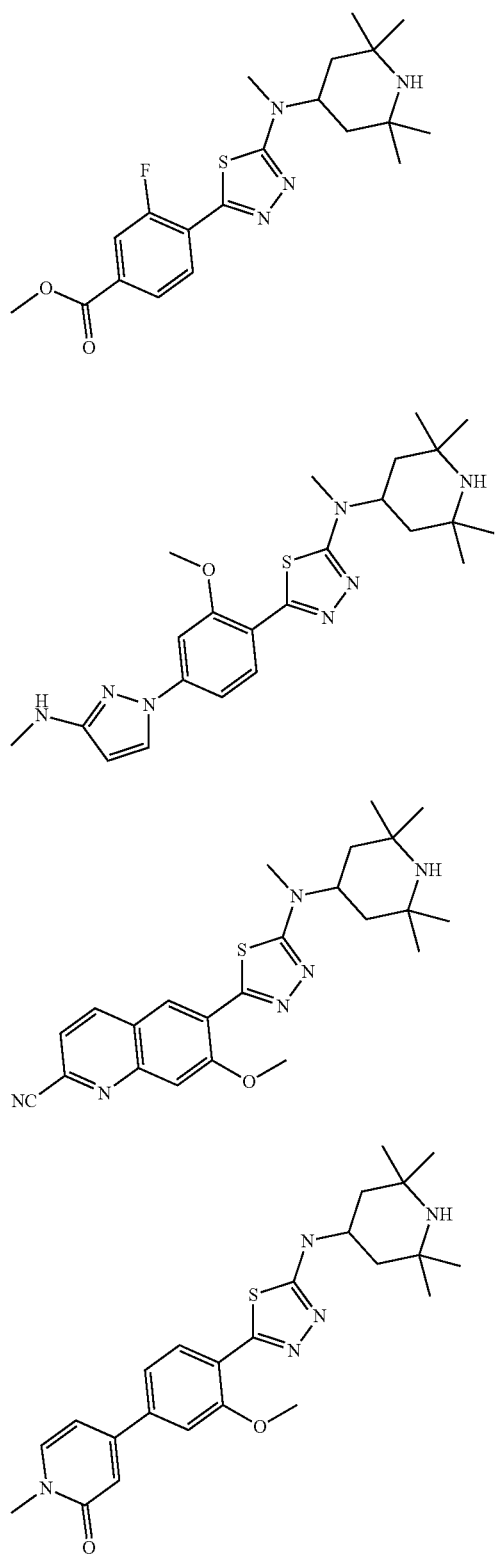
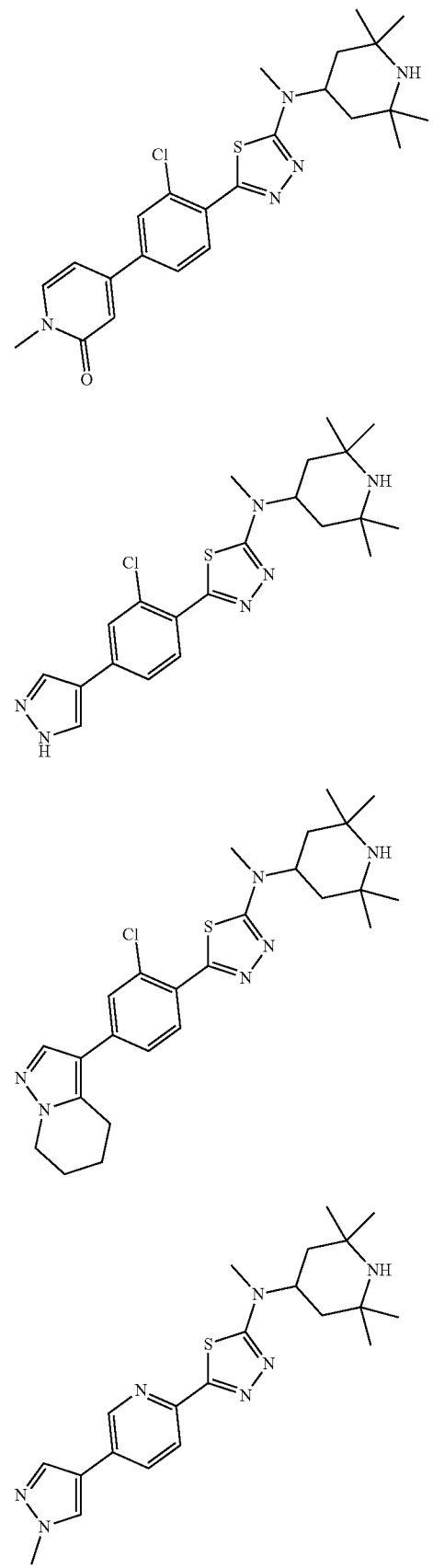

253
-continued
343
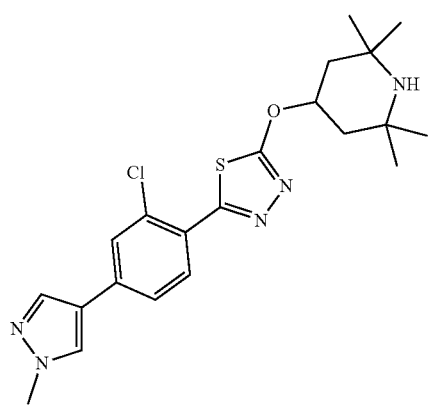
344
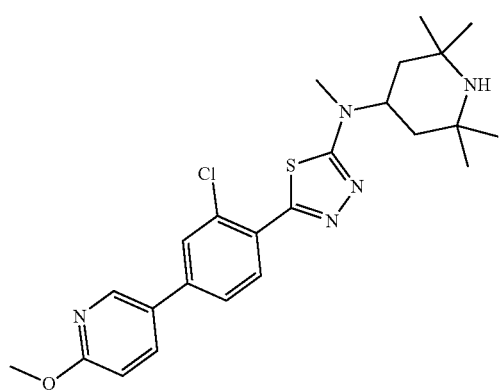
345
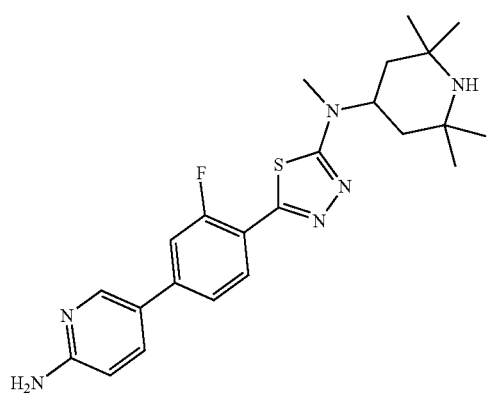
346
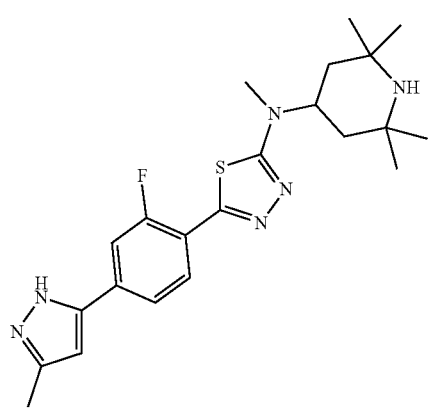
254
-continued
347
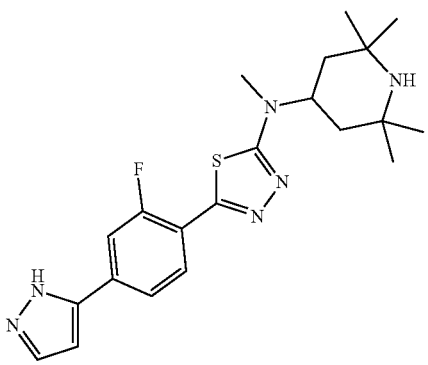
348
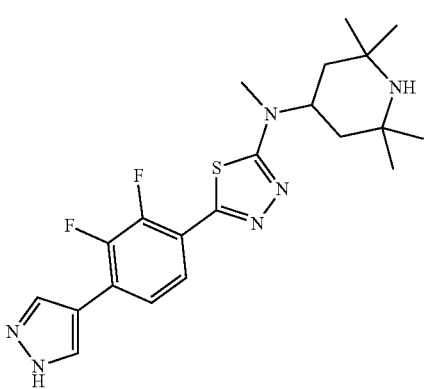
349
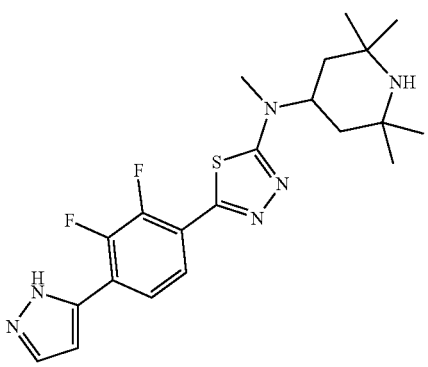
350
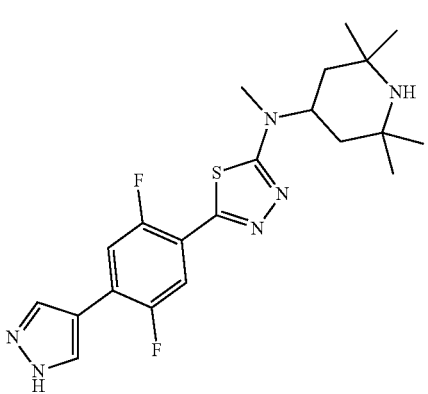

| 351 | 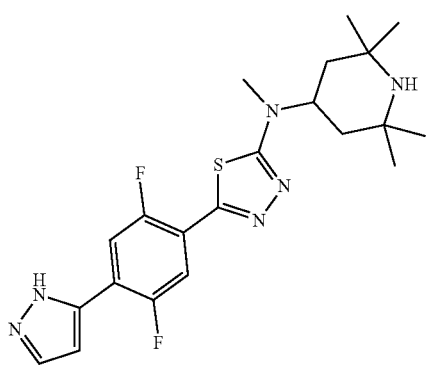 | 355 | 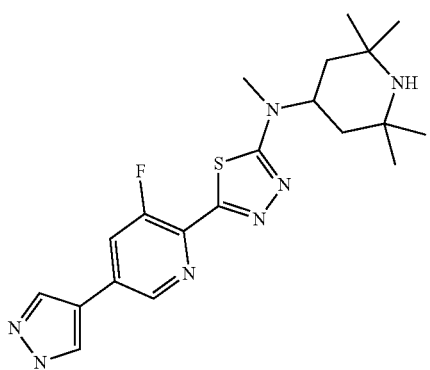 |
| 352 | 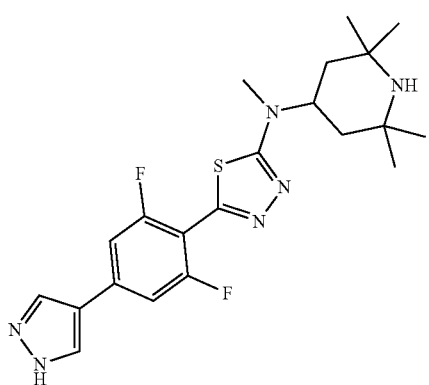 | 356 | 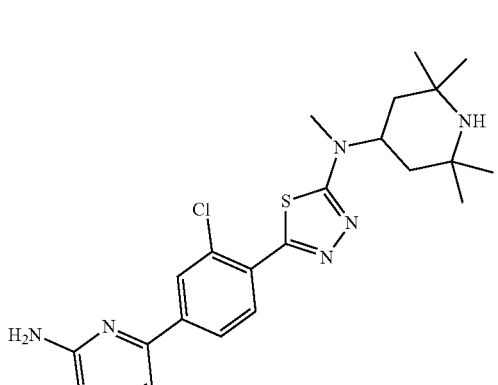 |
| 353 | 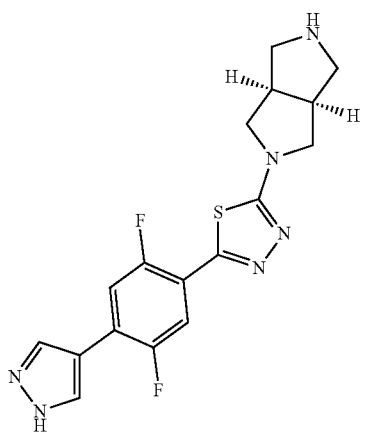 | 357 | 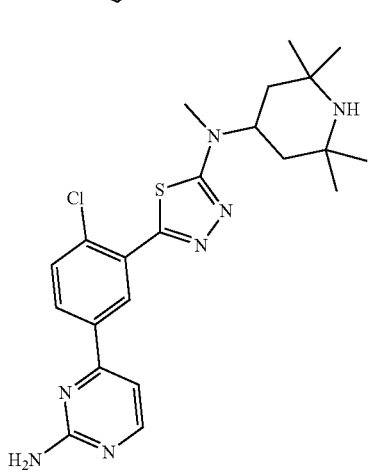 |
| 354 | 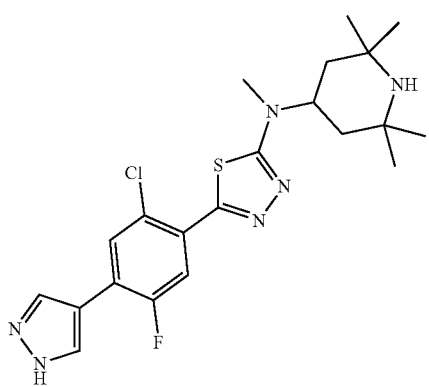 | 358 | 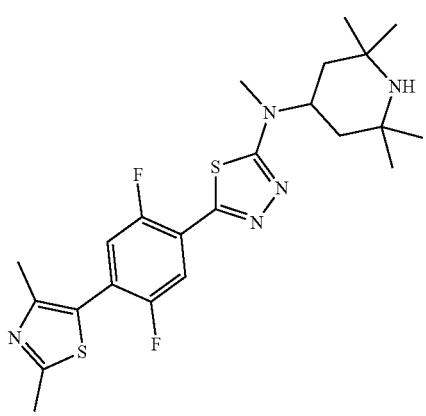 |

359
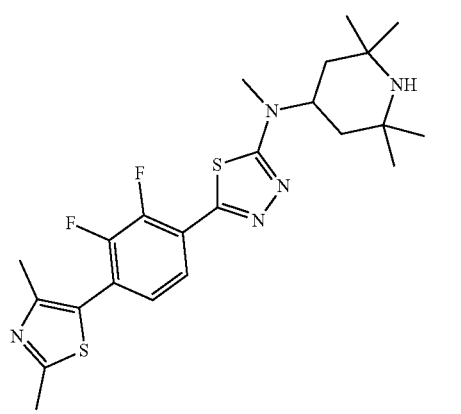
360
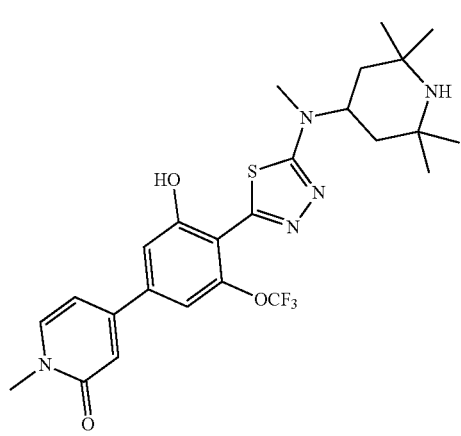
361
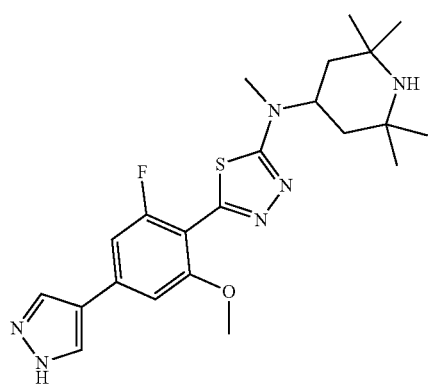
362
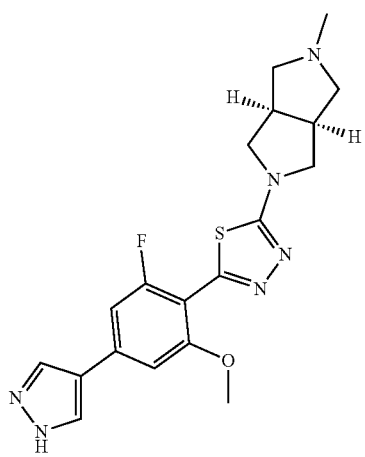
363
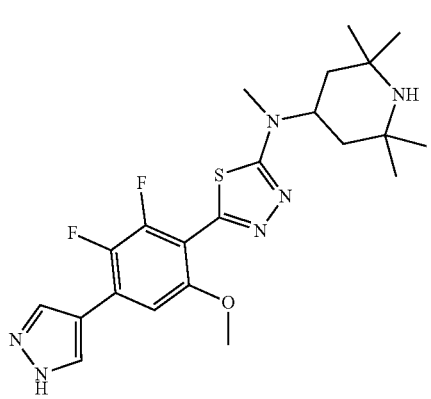
364
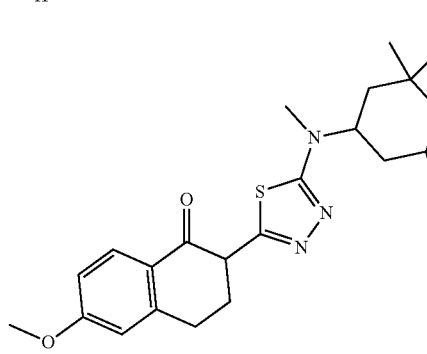
365
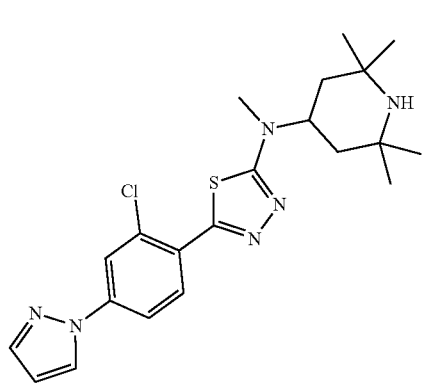

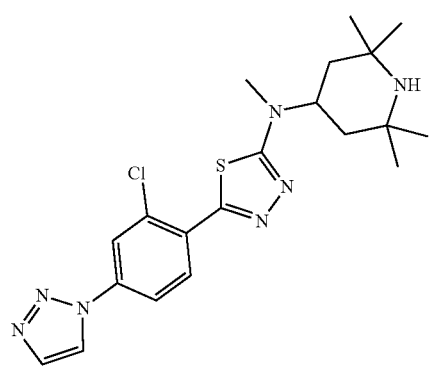
366
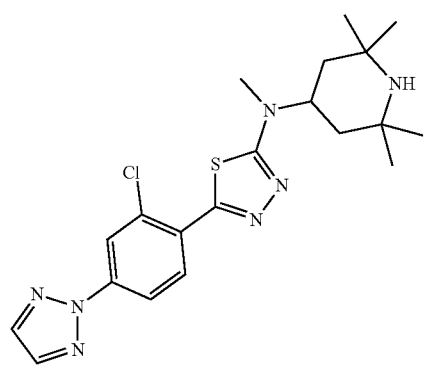
367
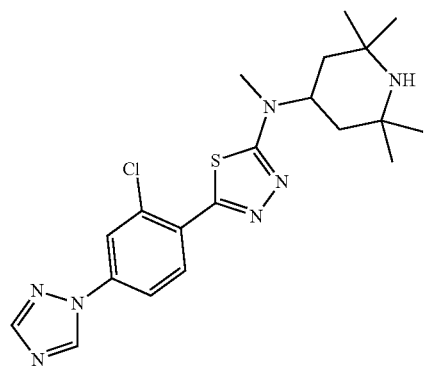
368
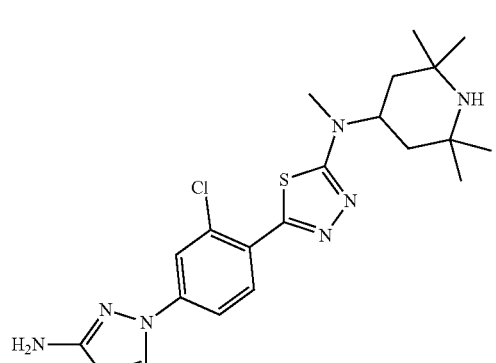
369
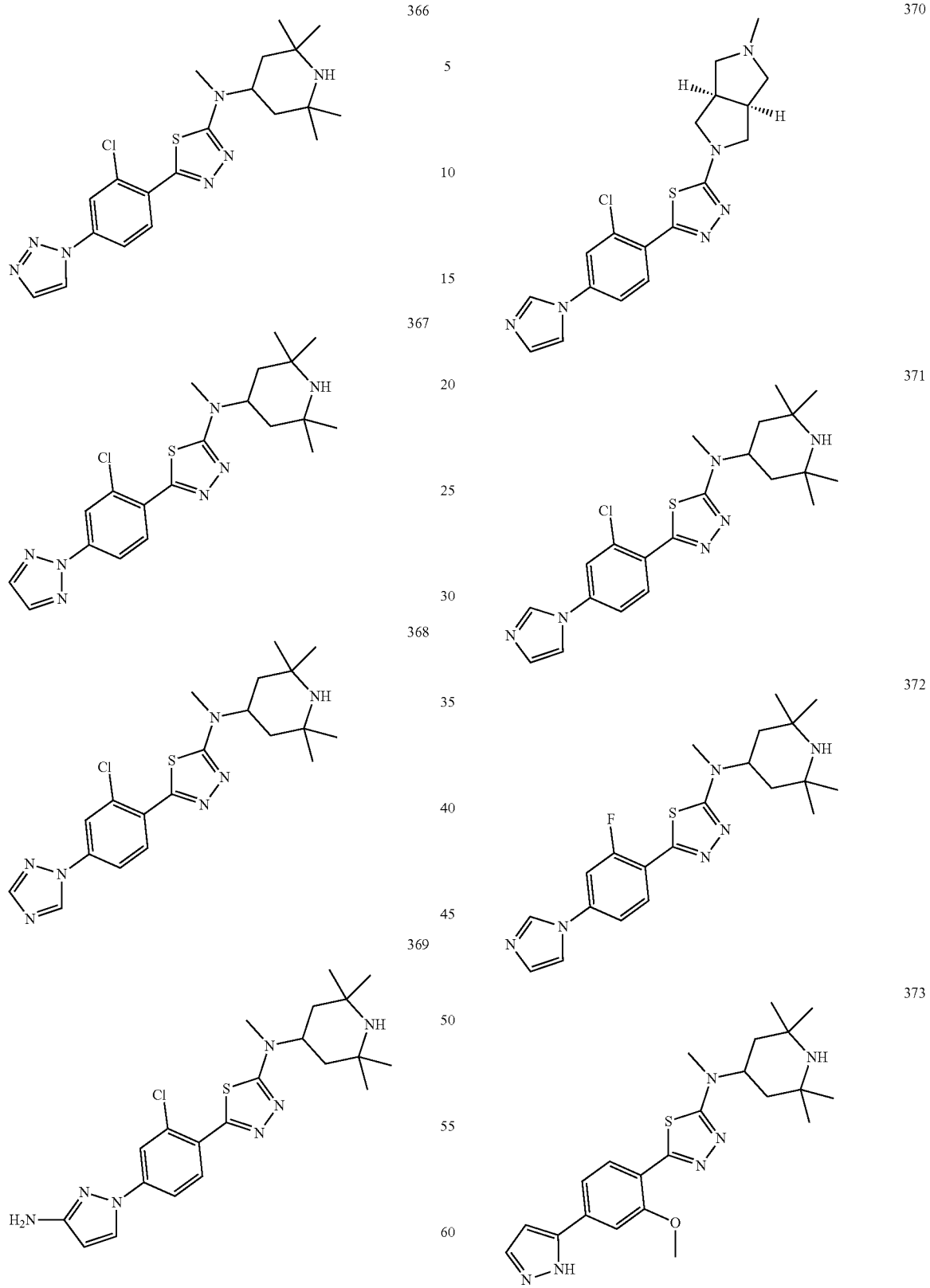

374 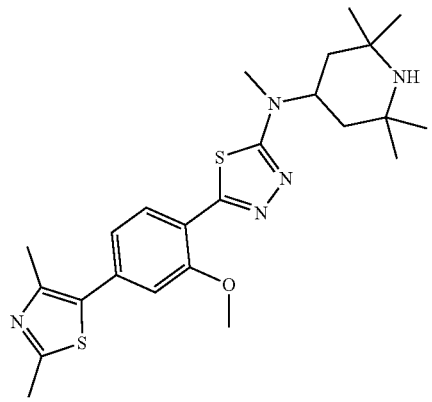
375 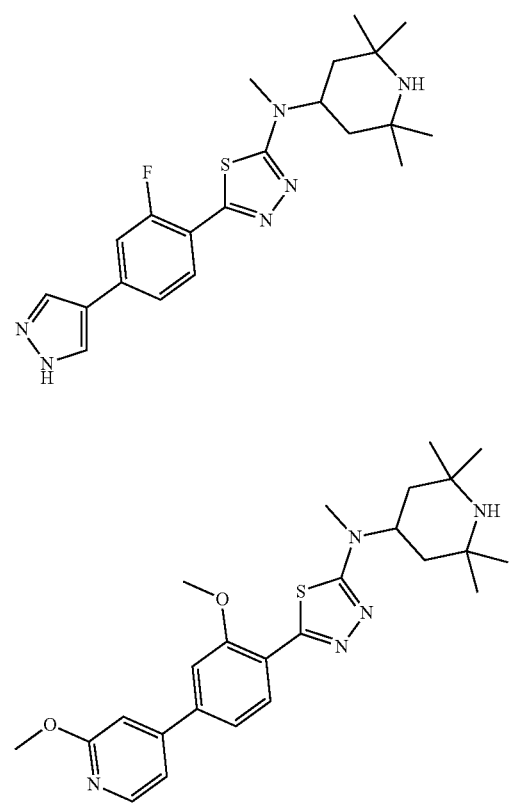
376
377 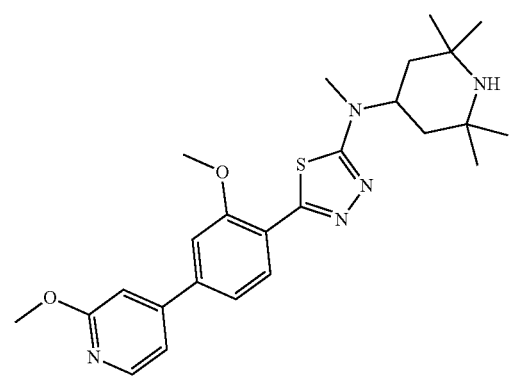
378 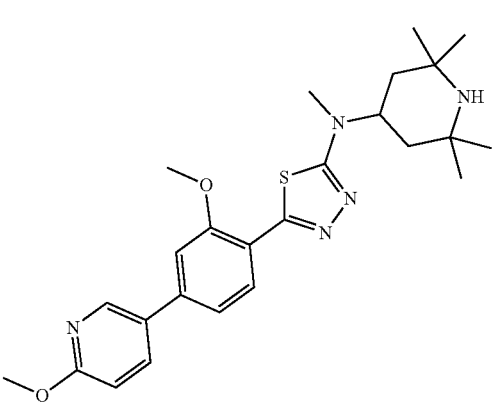
379 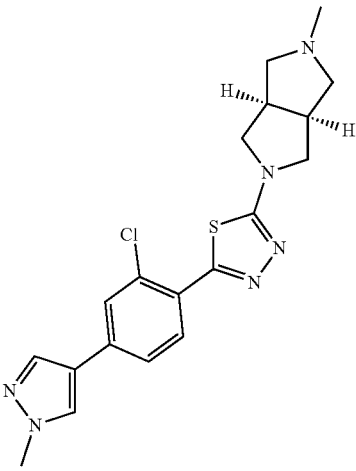
380 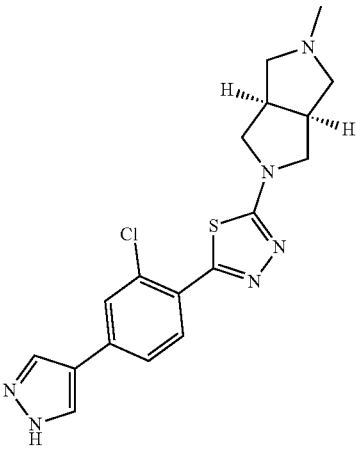

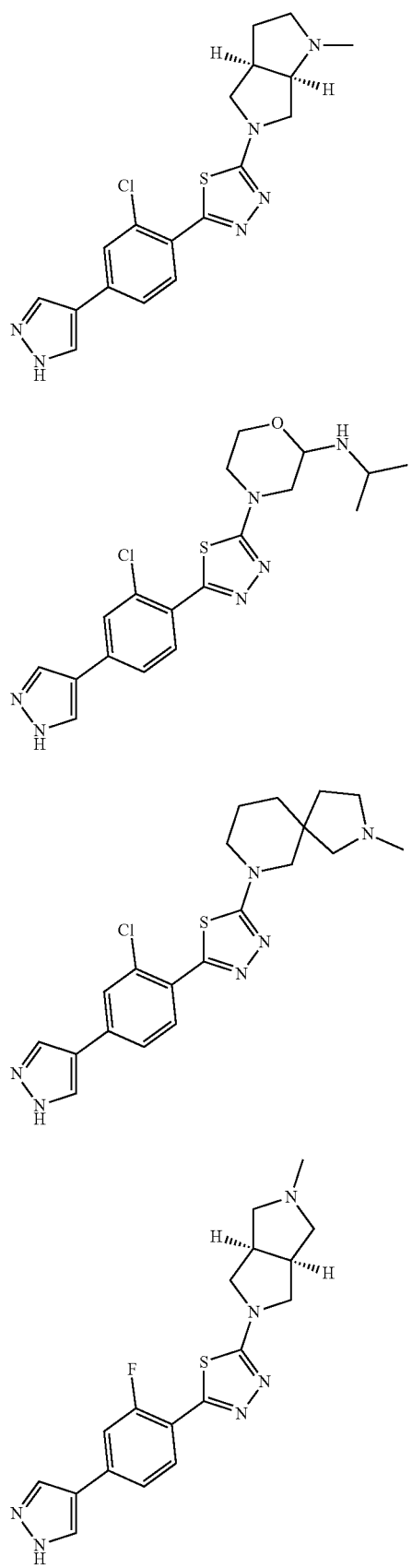
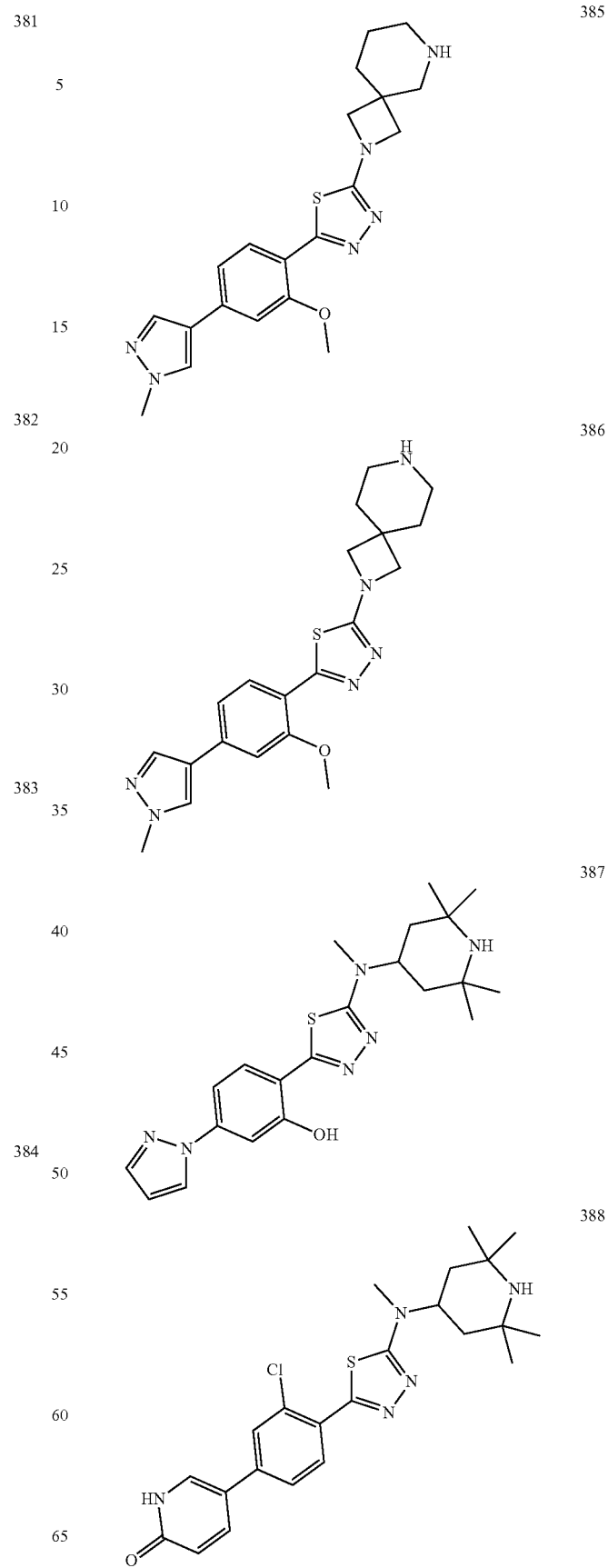

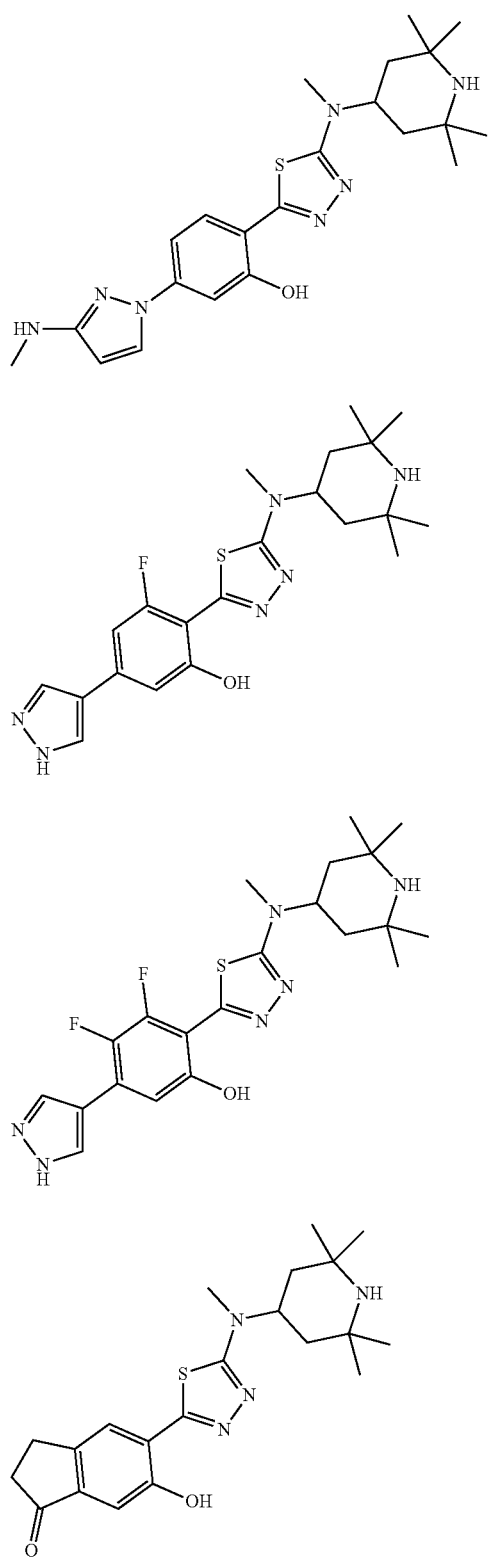
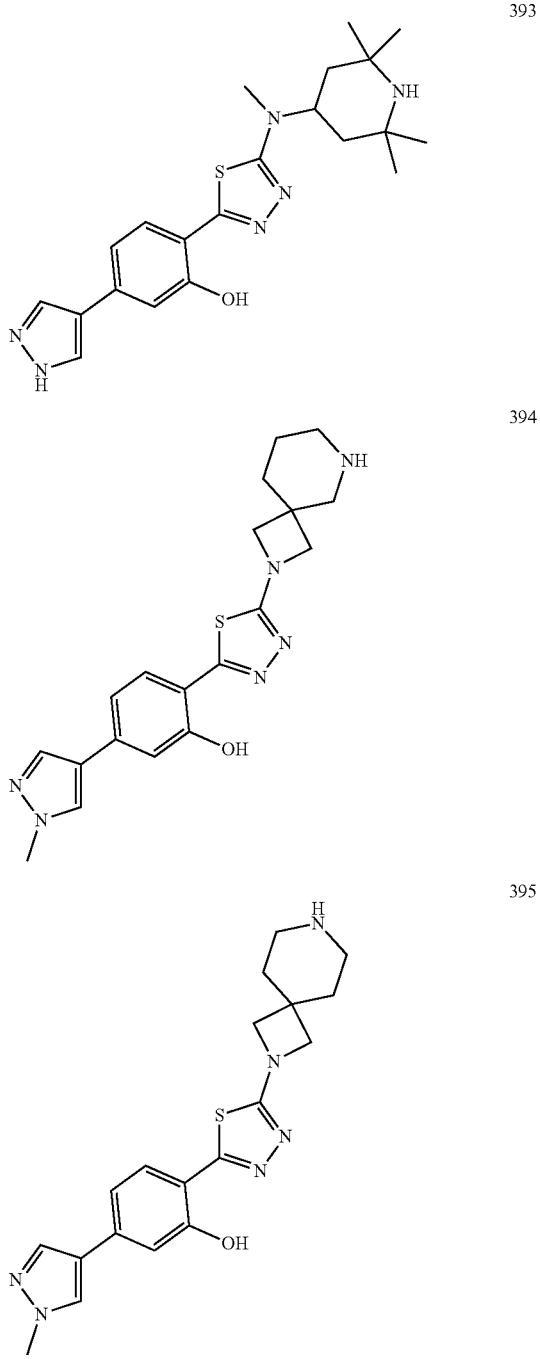

| 396 | 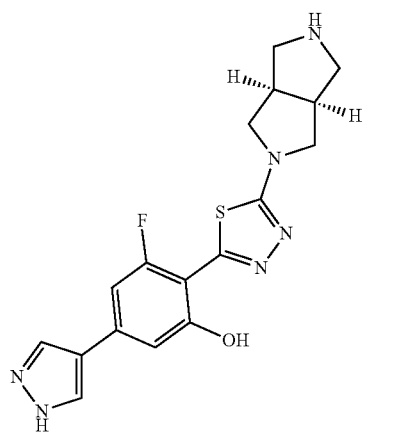 | 400 | 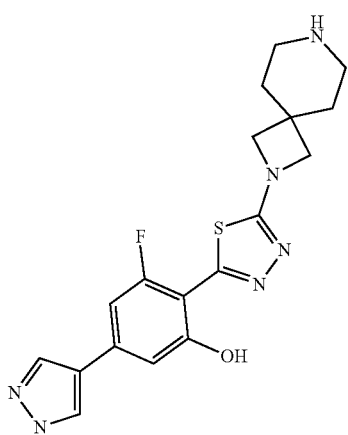 |
| 397 | 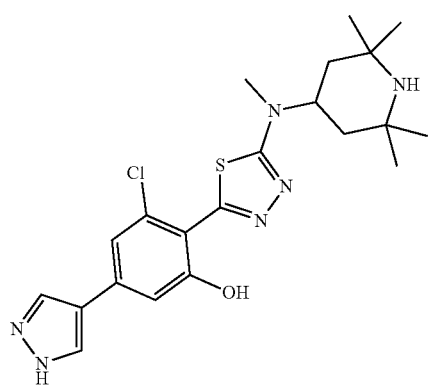 | 401 | 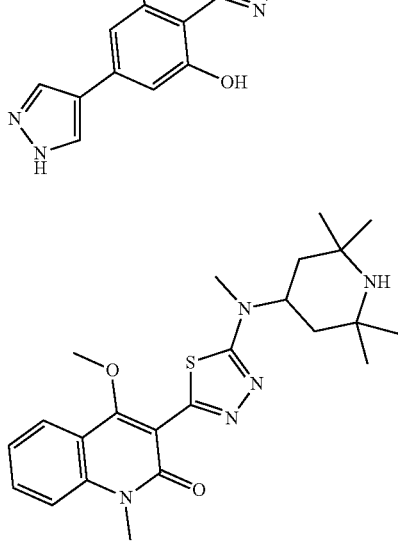 |
| 398 | 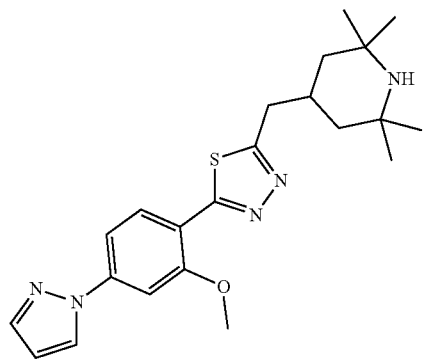 | 402 | 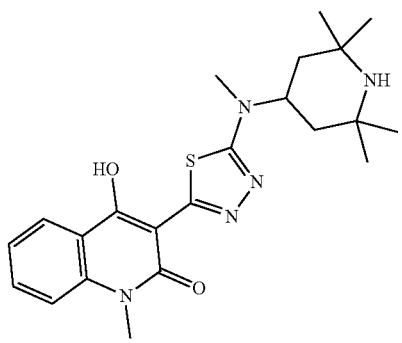 |
| 399 | 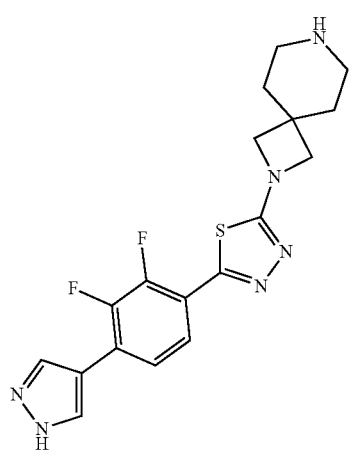 | 403 | 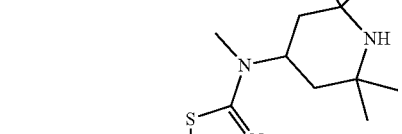 |

404 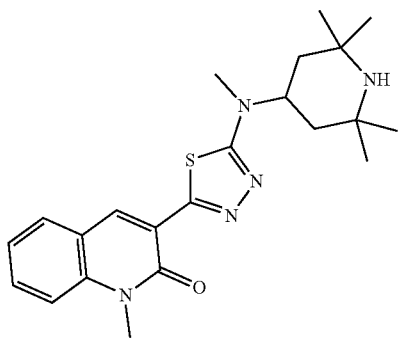
405 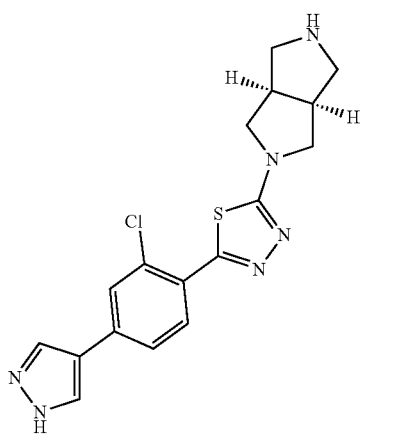
406 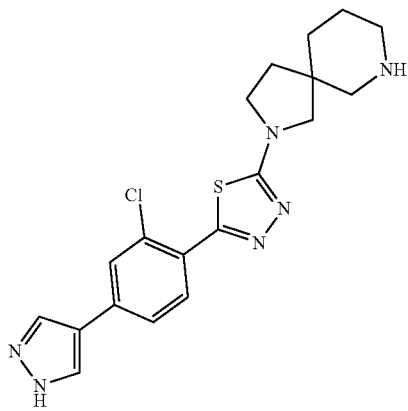
407 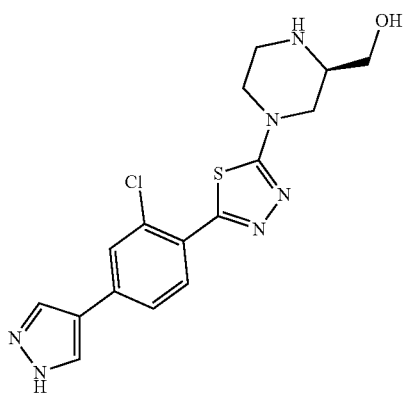
408 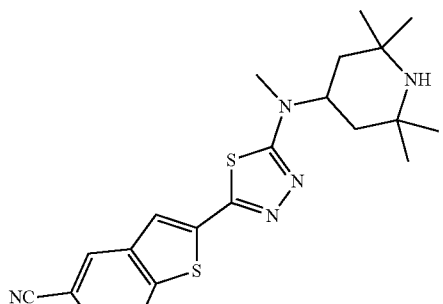
409 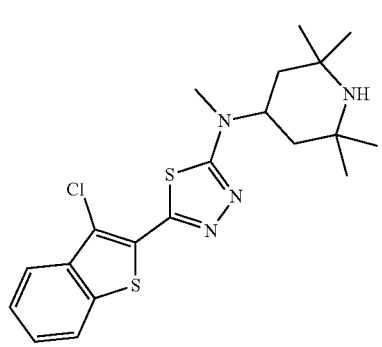
410 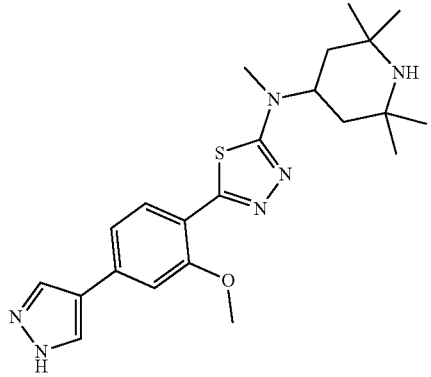
411 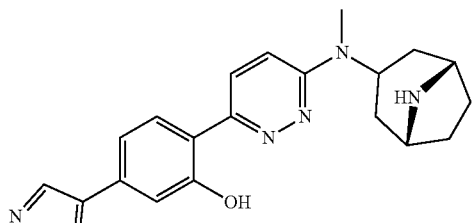
412 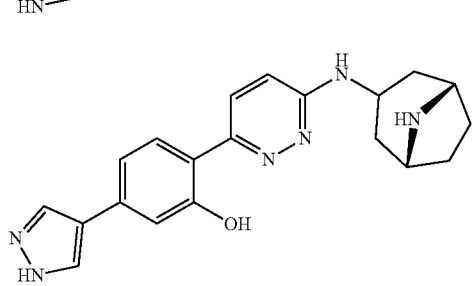

413
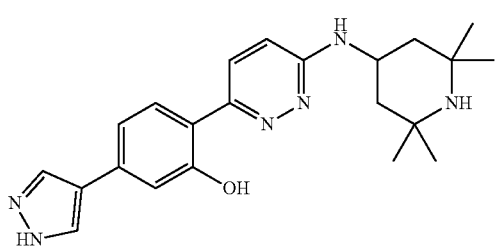
414
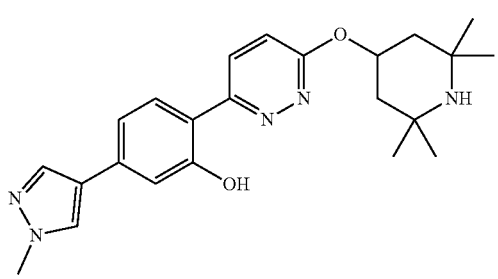
415
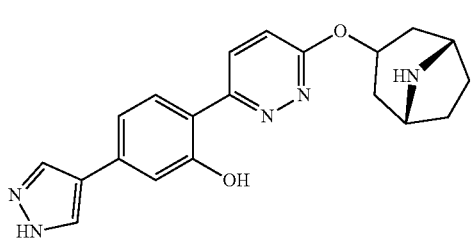
416
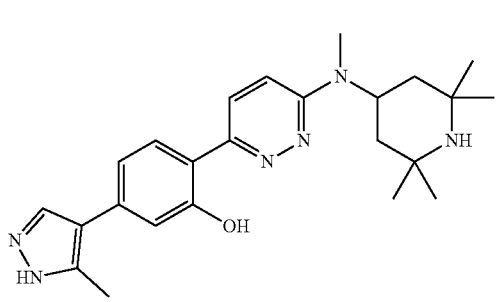
417
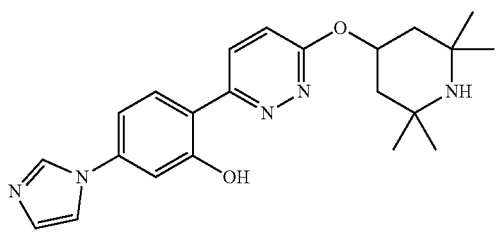
418
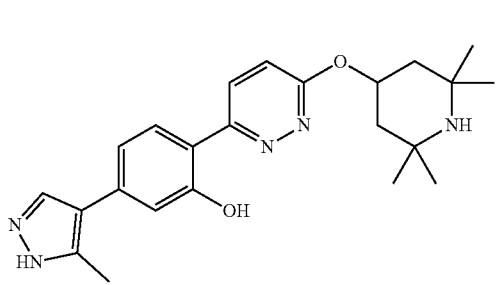
419
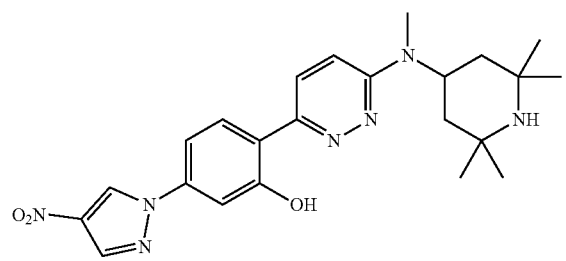
420
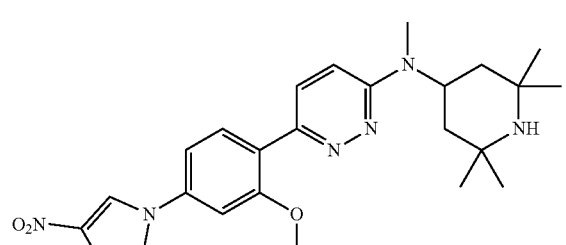
421
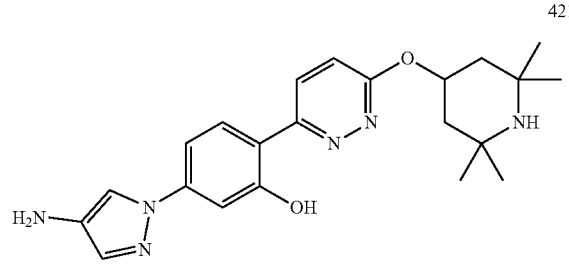
422
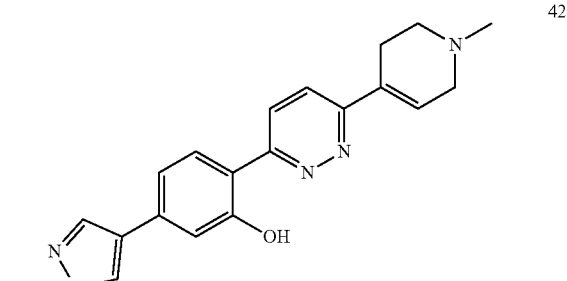
423
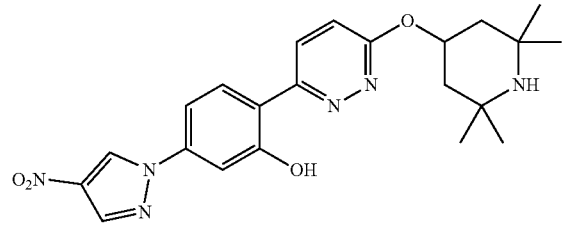
424
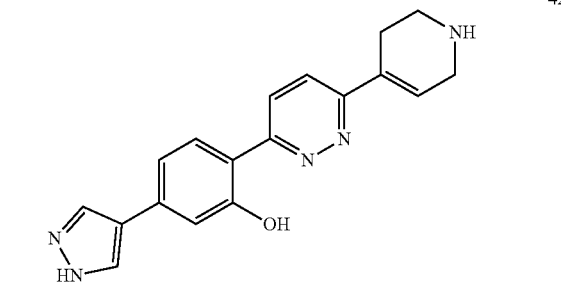

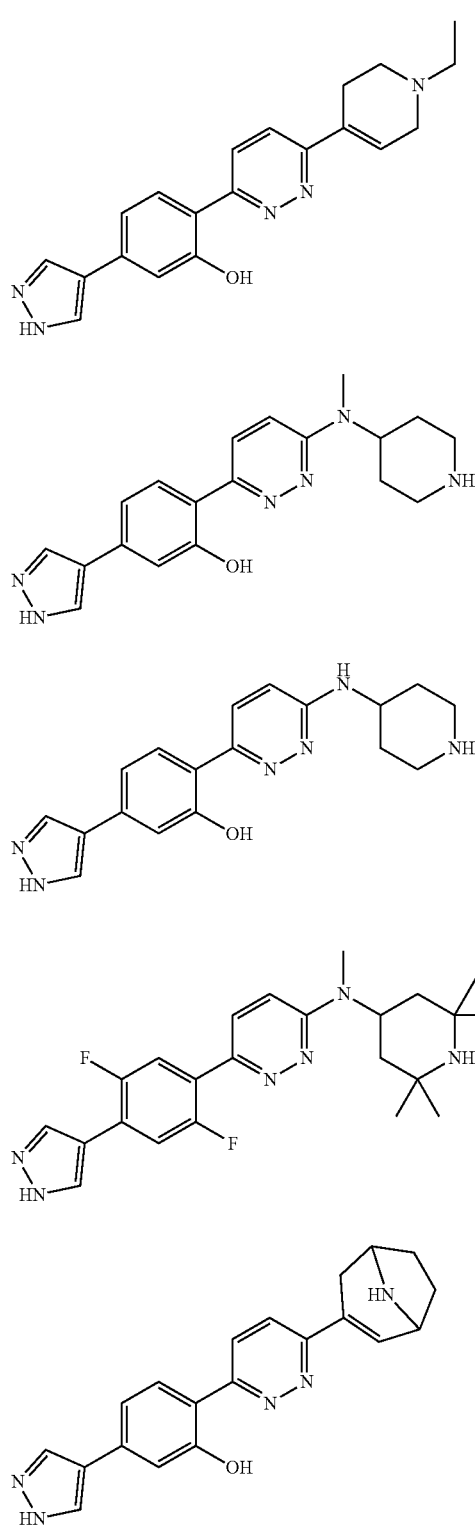
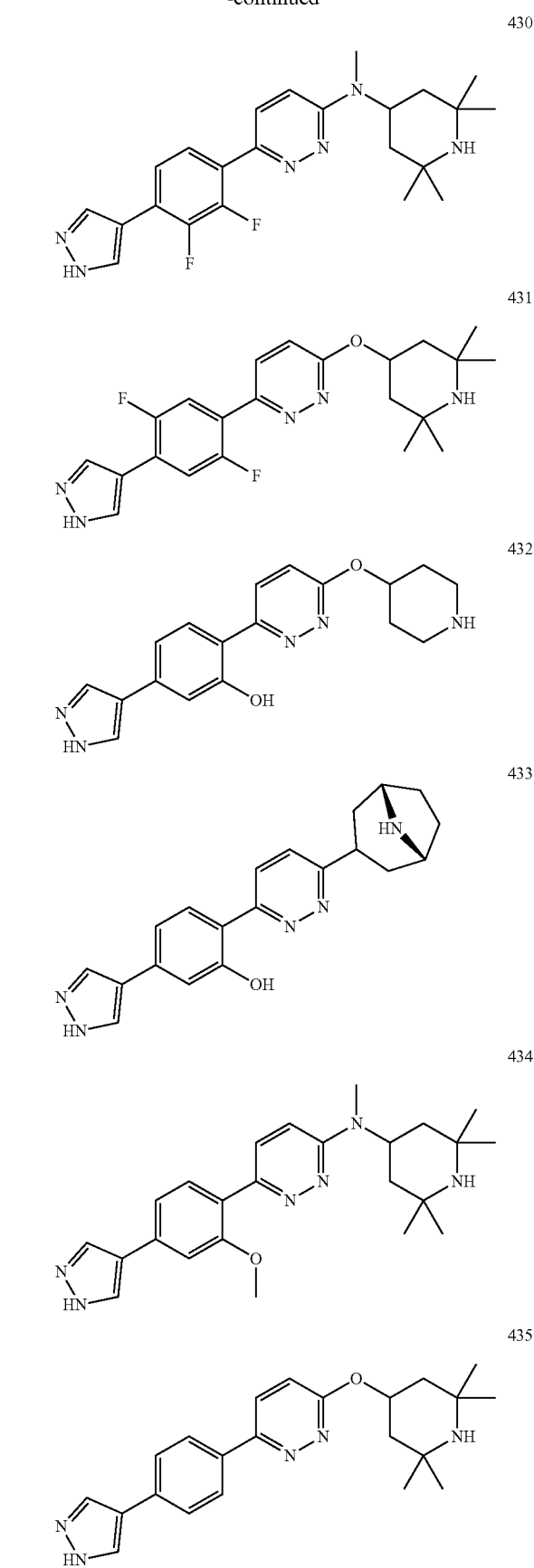

436
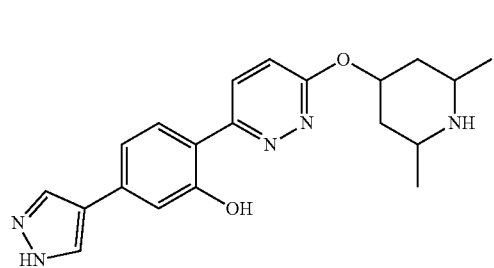
437
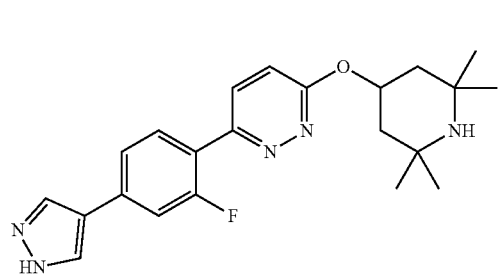
438
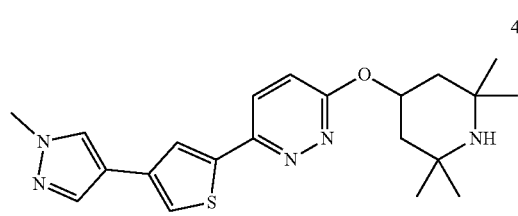
439
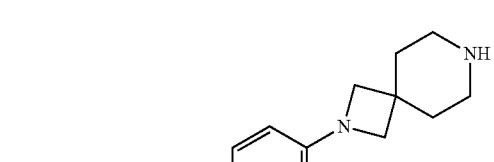
440
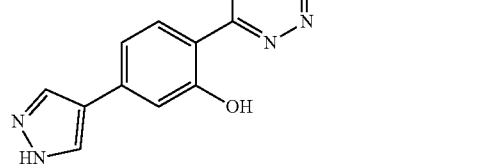
441
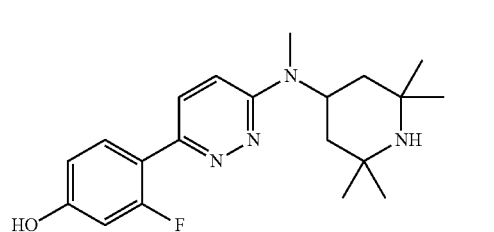
442
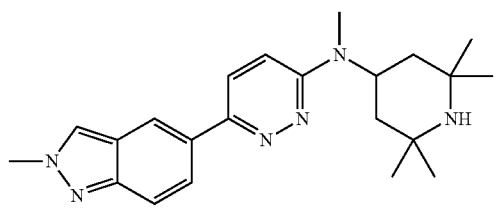
443
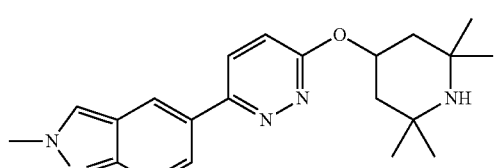
444
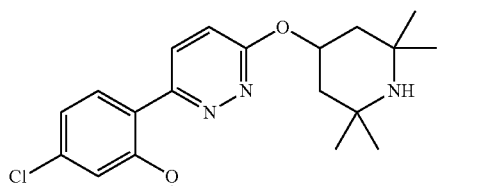
445
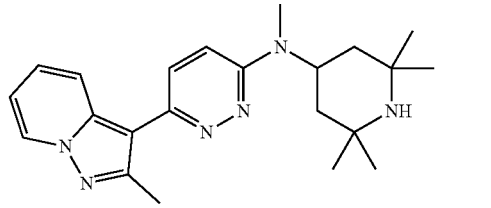
446
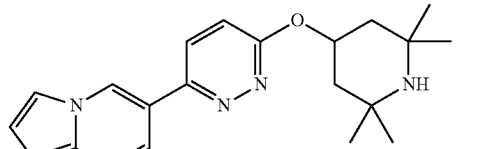
447
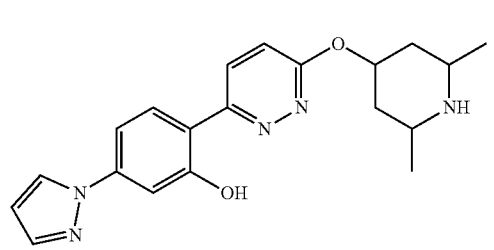
448
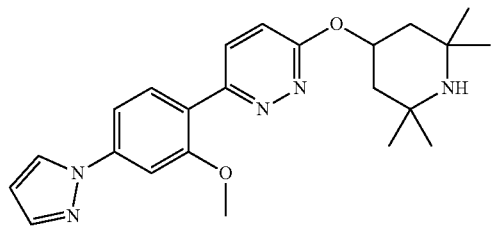

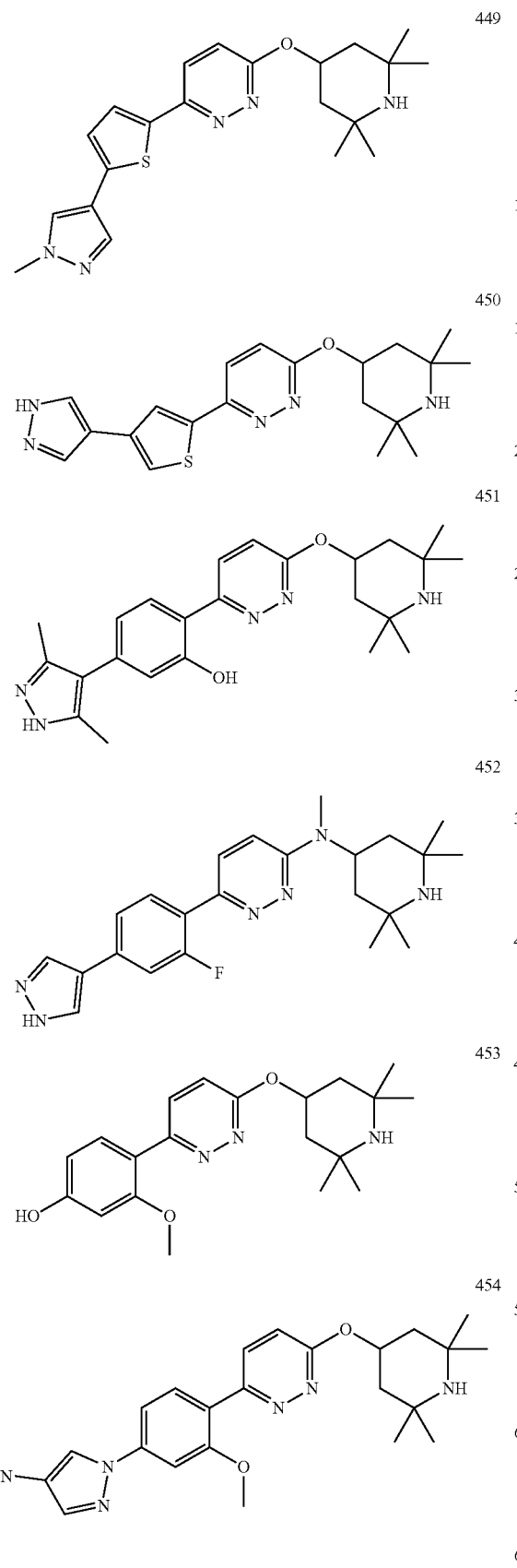
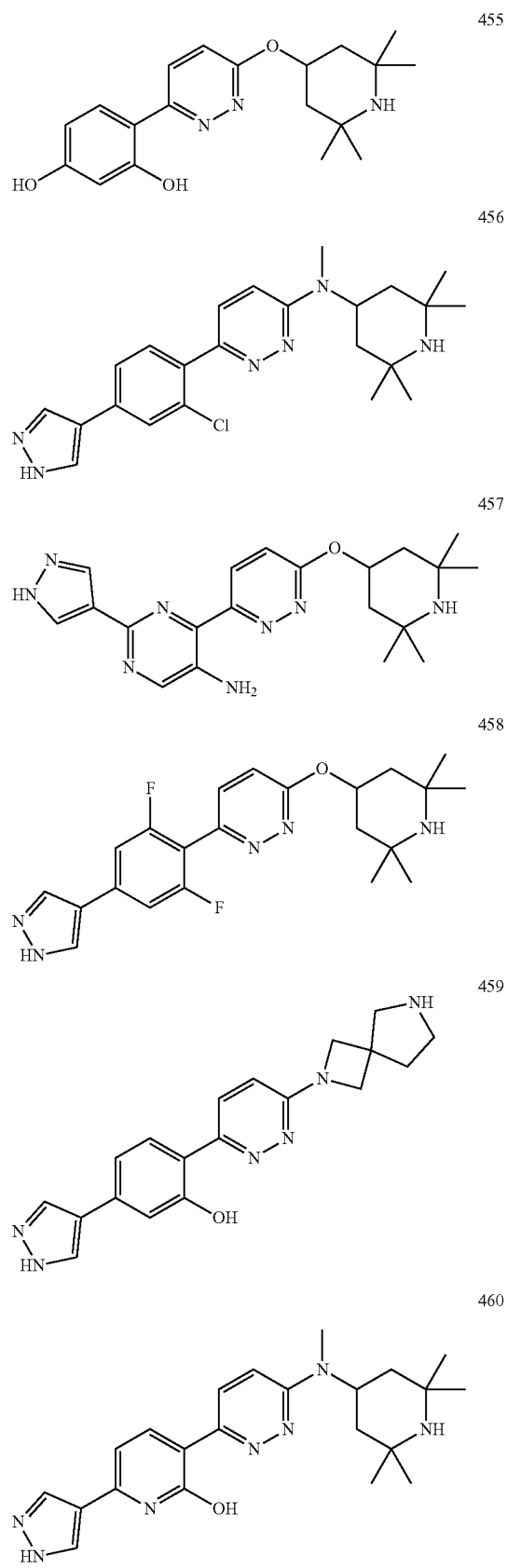

461
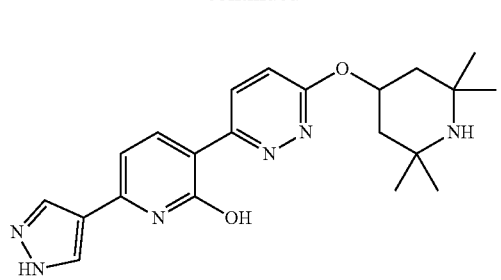
462
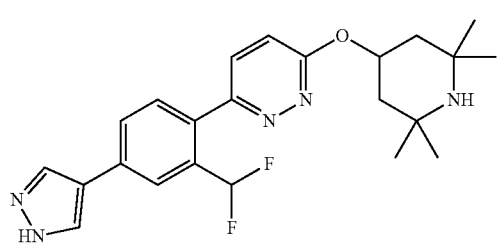
463
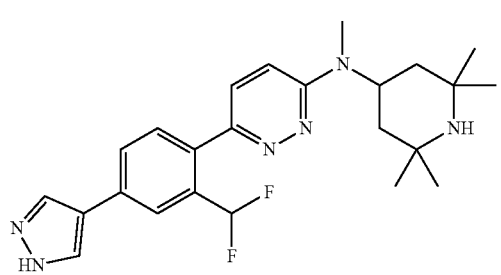
464
465
411
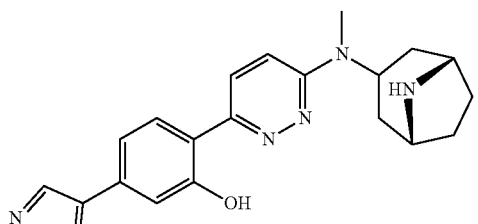
412
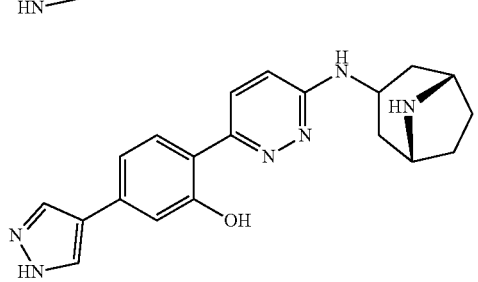
413
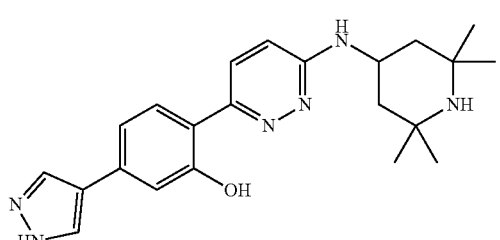
414
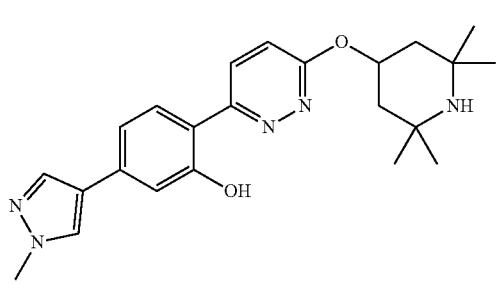
415
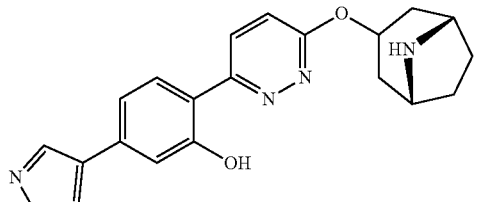
416
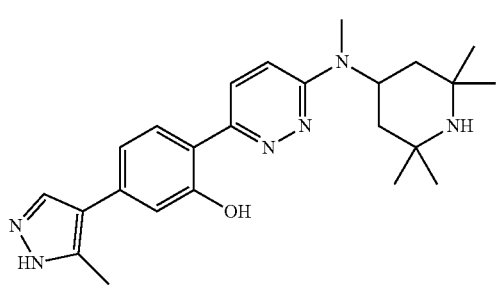
wherein a form of the compound is selected from the group consisting of a prodrug, salt, hydrate, solvate, clathrate, isotopologue, racemate, enantiomer, diastereomer, stereoisomer, polymorph and tautomer form thereof.
In another aspect, the compound of Formula (I) used in a method disclosed herein is a compound selected from the group consisting of:

-continued
417
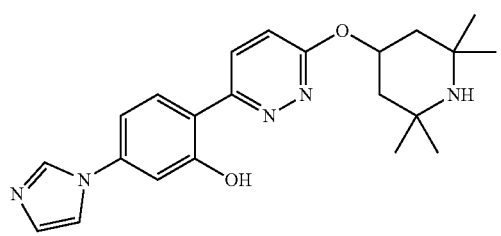
418
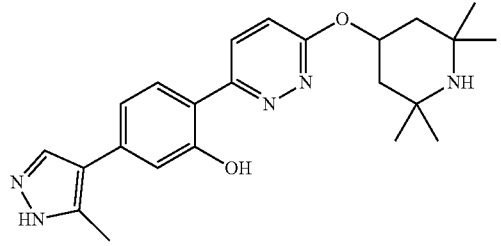
419
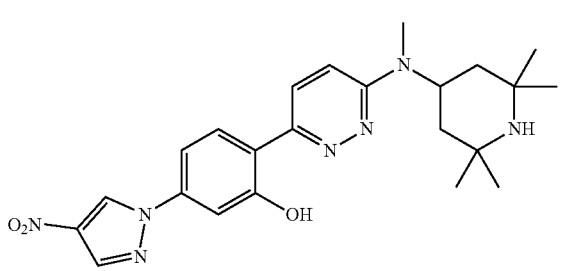
420
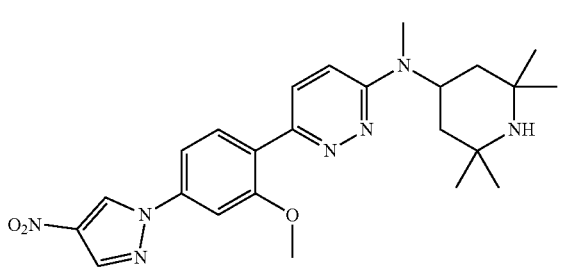
421
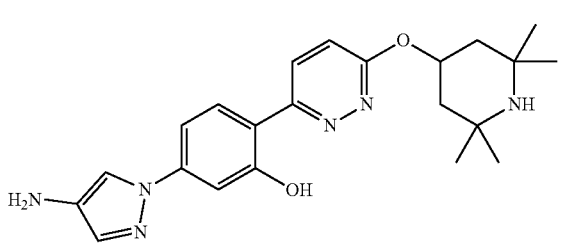
422
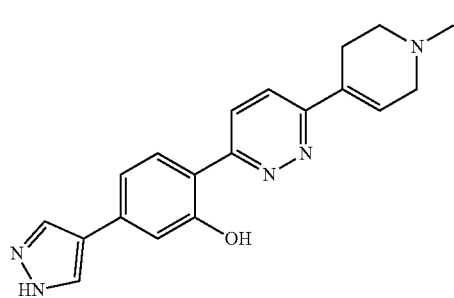
-continued
423
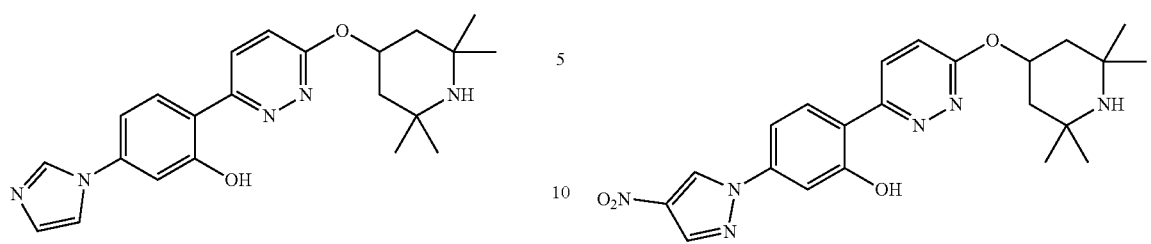
424
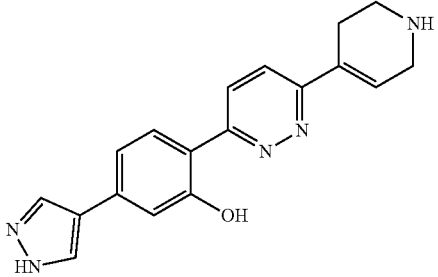
425
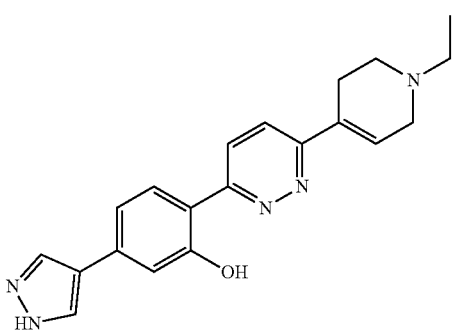
426
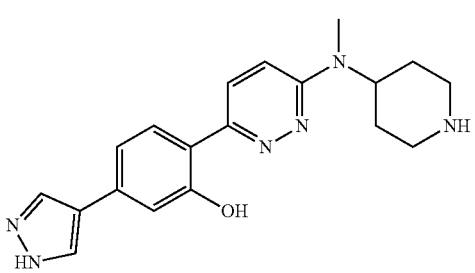
427
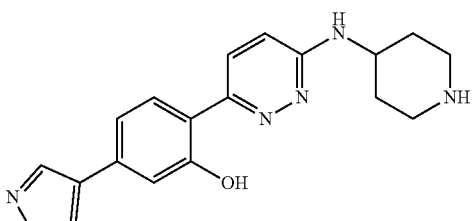

428 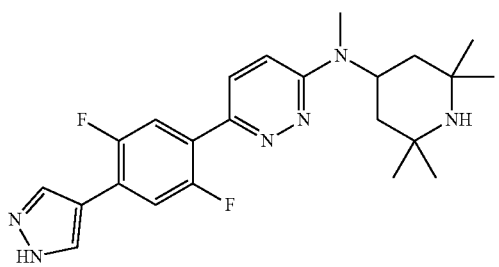
429 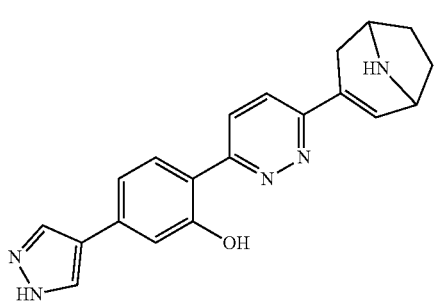
430 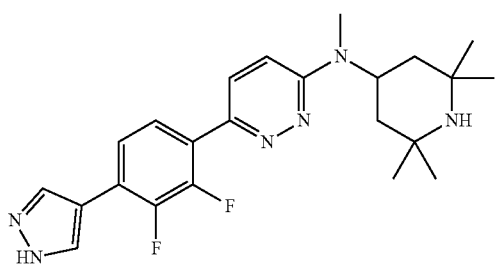
431 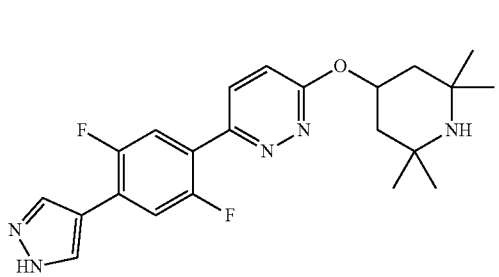
432 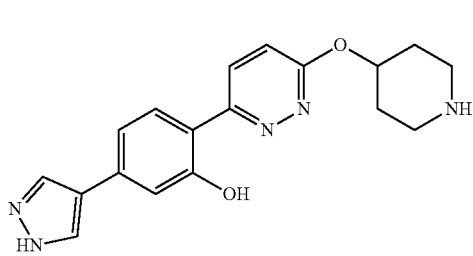
433 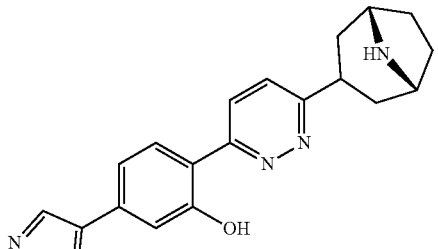
434 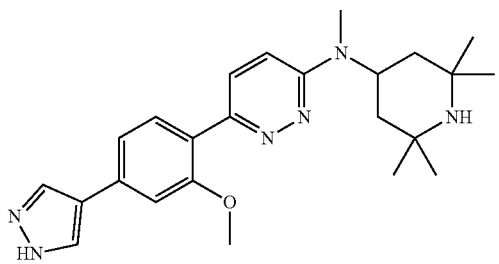
435 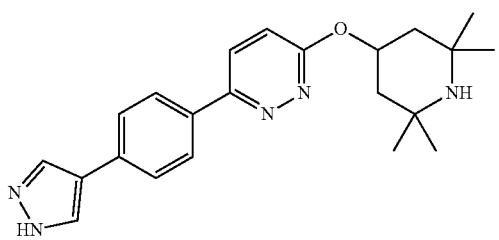
436 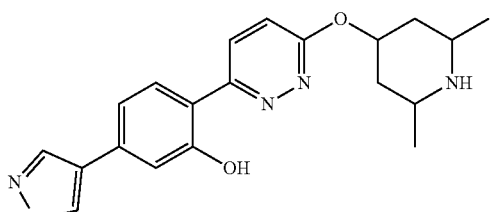
437 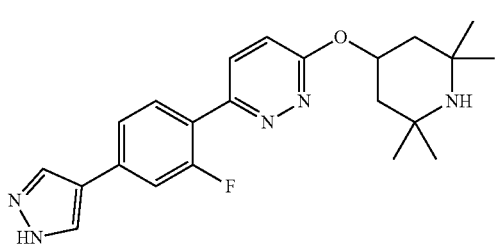
438 

285
-continued
439
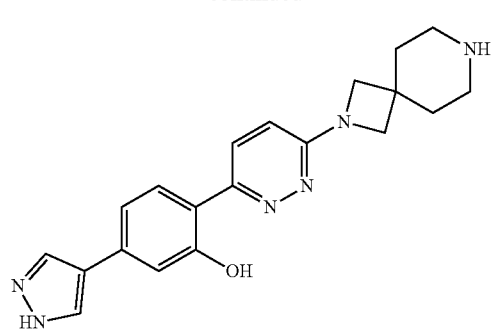
440
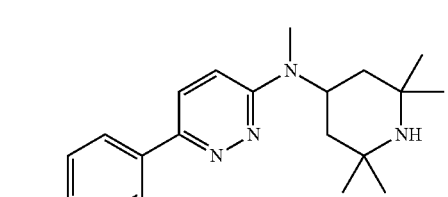
441
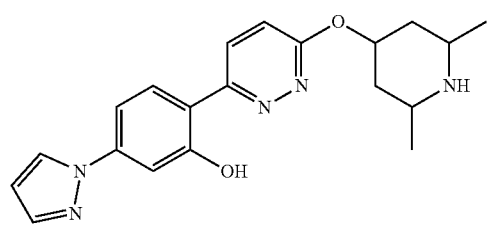
442
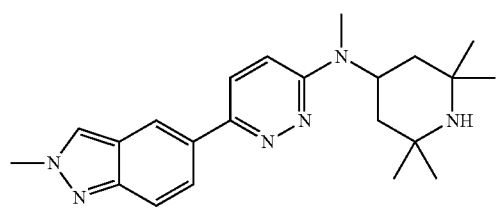
443
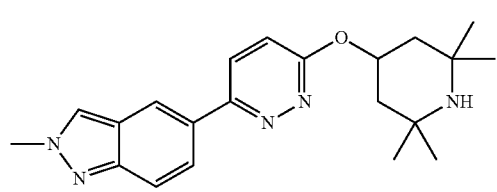
444
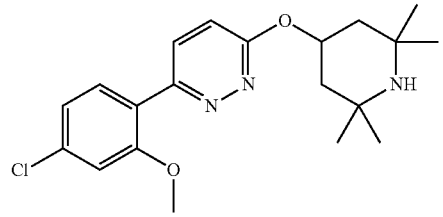
445
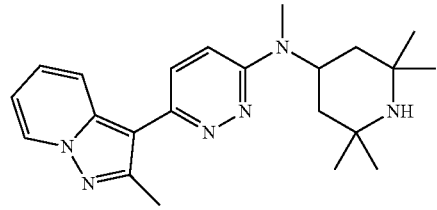
286
-continued
446
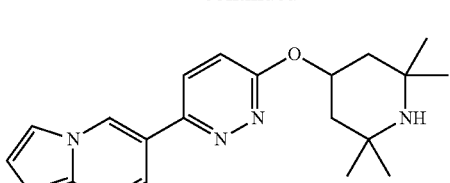
447
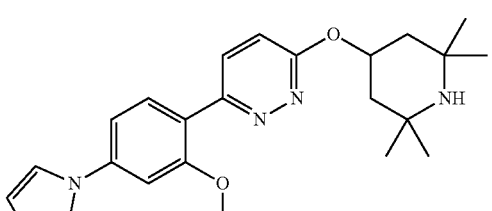
448
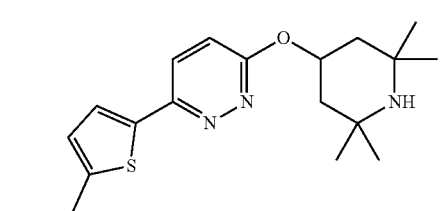
449
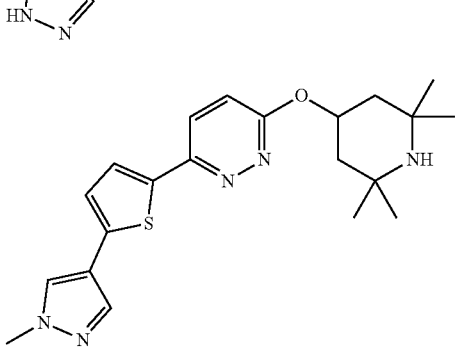
450
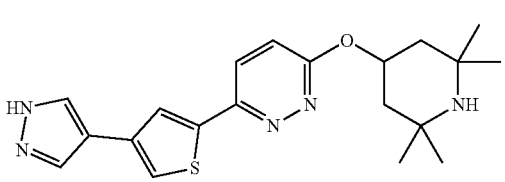
451
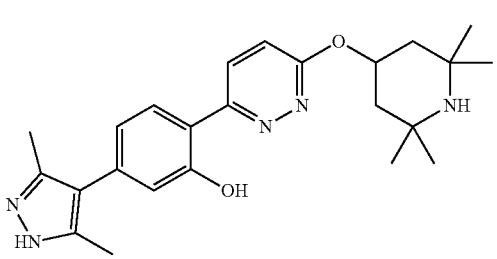

| 452 | 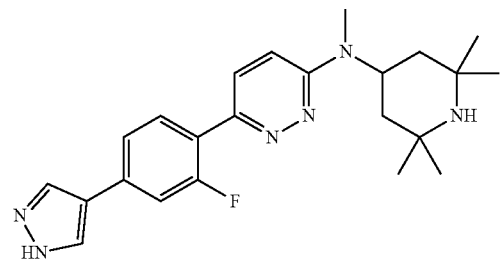 |
| 453 | 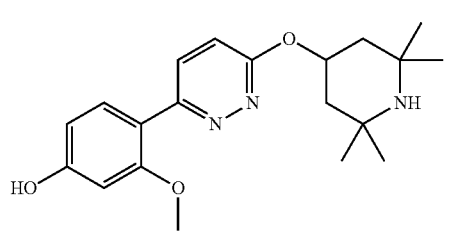 |
| 454 |  |
| 455 | 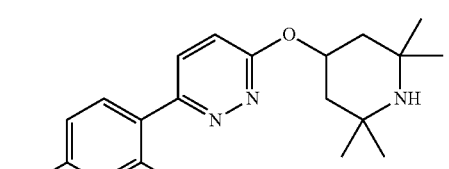 |
| 456 | 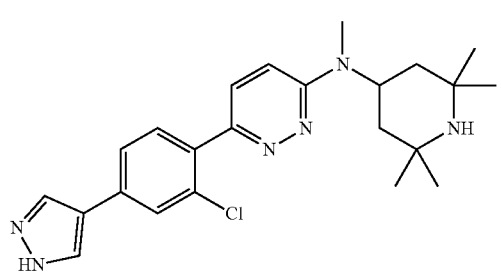 |
| 457 | 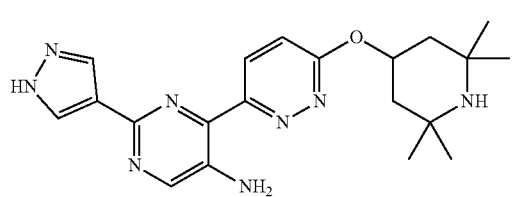 |
| 458 | 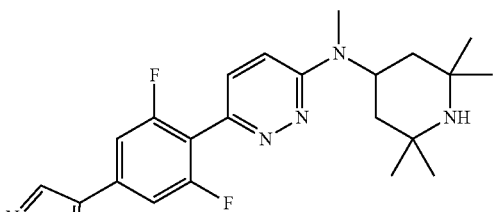 |
| 459 | 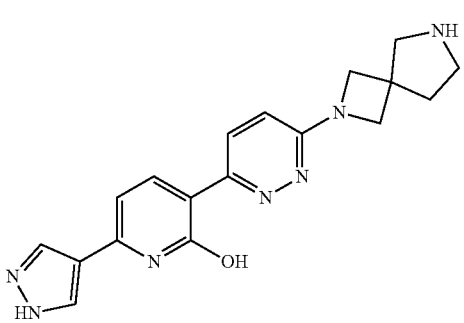 |
| 460 | 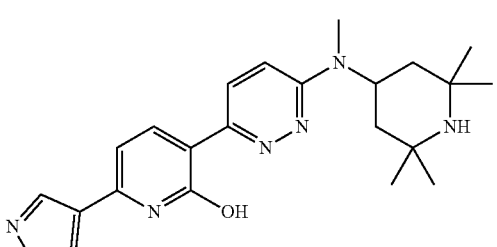 |
| 461 | 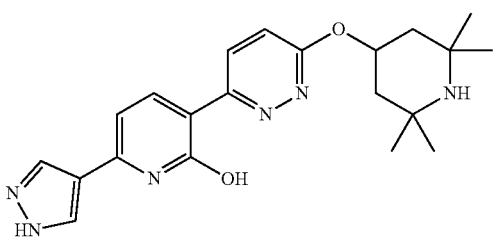 |
| 462 | 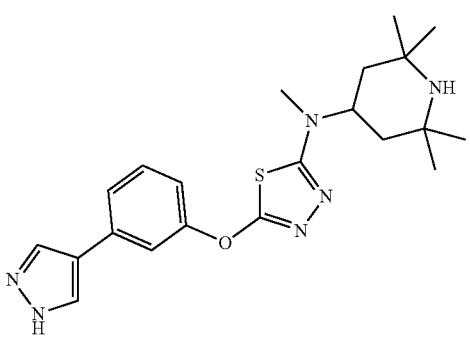 |

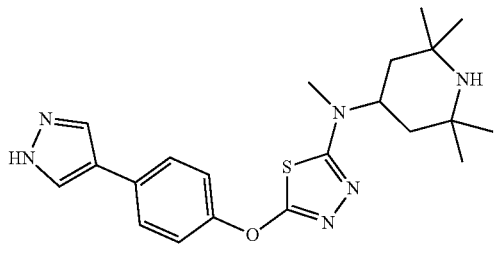

463

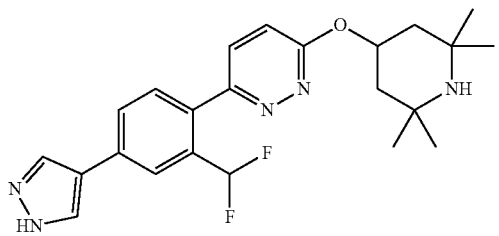

464

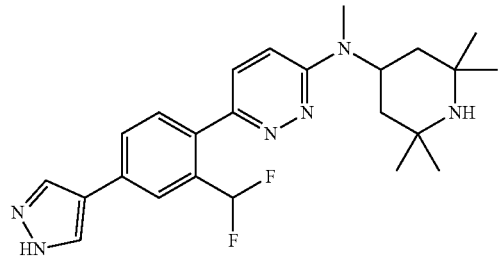

465 wherein a form of the compound is selected from the group consisting of a prodrug, salt, hydrate, solvate, clathrate, isotopologue, racemate, enantiomer, diastereomer, stereoisomer, polymorph and tautomer form thereof.

In another aspect, the compound of Formula (I) or a form thereof used in a method disclosed herein is a compound of Formula (I) or a form thereof (wherein compound number ($\#^1$) indicates that the salt form was isolated) selected from the group consisting of:

| Cpd | Name |
|---|---|
| 1 | 6-(naphthalen-2-yl)-N-(2,2,6,6-tetramethylpiperidin-4-yl)pyridazin-3-amine |
| 2 | 6-(benzo[b]thiophen-2-yl)-N-methyl-N-(2,2,6,6-tetramethylpiperidin-4-yl)pyridazin-3-amine |
| 3 | 2-(6-(2,2,6,6-tetramethylpiperidin-4-yl-amino)-pyridazin-3-yl)phenol |
| 4 | 2-(6-(methyl-(2,2,6,6-tetramethylpiperidin-4-yl)amino)pyridazin-3-yl)benzo[b]-thiophene-5-carbonitrile |
| 5 | 6-(quinolin-3-yl)-N-(2,2,6,6-tetramethylpiperidin-4-yl)pyridazin-3-amine |
| 6 | 3-(benzo[b]-thiophen-2-yl)-6-(2,2,6,6-tetramethylpiperidin-4-yl-oxy)pyridazine |
| 7 | 2-(6-(methyl-(2,2,6,6-tetramethylpiperidin-4-yl)amino)-pyridazin-3-yl)phenol |
| 8 | 6-(6-(methyl-(2,2,6,6-tetramethylpiperidin-4-yl)amino)-pyridazin-3-yl)naphthalen-2-ol |
| 9 | 6-(benzo[b]-thiophen-2-yl)-N-(2,2,6,6-tetramethylpiperidin-4-yl)pyridazin-3-amine |
| 10 | 7-(6-((2,2,6,6-tetramethylpiperidin-4-yl)oxy)pyridazin-3-yl)isoquinoline |
| 11 | 6-(6-((2,2,6,6-tetramethylpiperidin-4-yl)oxy)pyridazin-3-yl)isoquinoline |
| 12 | N-methyl-6-(quinolin-7-yl)-N-(2,2,6,6-tetramethylpiperidin-4-yl)pyridazin-3-amine |
| 13 | N-methyl-6-(quinolin-6-yl)-N-(2,2,6,6-tetramethylpiperidin-4-yl)pyridazin-3-aniine |
| 14 | 6-(isoquinolin-7-yl)-N-methyl-N-(2,2,6,6-tetramethylpiperidin-4-yl)pyridazin-3-amine |
| 15 | 6-(isoquinolin-6-yl)-N-methyl-N-(2,2,6,6-tetramethylpiperidin-4-yl)pyridazin-3-amine |
| 16 | 6-(imidazo[1,2-a]pyridin-6-yl-pyridazin-3-yl)-methyl-(2,2,6,6-tetramethylpiperidin-4-yl)-amine |
| 17 | N-methyl-6-(6-phenylpyridin-3-yl)-N-(2,2,6,6-tetramethylpiperidin-4-yl)pyridazin-3-amine |
| 18 | 6-(6-(1H-pyrrol-1-yl)pyridin-3-yl)-N-methyl-N-(2,2,6,6-tetramethylpiperidin-4-yl)pyridazin-3-amine |
| 19 | 6-(6-(1H-pyrazol-1-yl)pyridin-3-yl)-N-methyl-N-(2,2,6,6-tetramethylpiperidin-4-yl)pyridazin-3-amine |
| 20 | methyl-(6-quinoxalin-2-yl-pyridazin-3-yl)-(2,2,6,6-tetramethylpiperidin-4-yl)-amine |
| 21 | methyl-(6-quinolin-3-yl-pyridazin-3-yl)-(2,2,6,6-tetramethylpiperidin-4-yl)-amine |
| 22 | N-methyl-6-(phthalazin-6-yl)-N-(2,2,6,6-tetramethylpiperidin-4-yl)pyridazin-3-amine |
| 23 | 6-(benzo[c][1,2,5]oxa-diazol-5-yl)-N-(2,2,6,6-tetramethylpiperidin-4-yl)pyridazin-3-amine |
| 24 | 6-(benzo[d]thiazol-5-yl)-N-(2,2,6,6-tetramethylpiperidin-4-yl)pyridazin-3-amine |
| 25 | 6-(2-methylbenzo-[d]oxazol-6-yl)-N-(2,2,6,6-tetramethylpiperidin-4-yl)pyridazin-3-amine |
| 26 | 3-(6-(methyl(2,2,6,6-tetramethylpiperidin-4-yl)amino)pyridazin-3-yl)naphthalen-2-ol |
| 27 | 5-chloro-2-(6-(methyl(1,2,2,6,6-pentamethylpiperidin-4-yl)amino)pyridazin-3-yl)phenol |
| 28 | 3-(6-(2,2,6,6-tetramethylpiperidin-4-yl-amino)pyridazin-3-yl)naphthalen-2-ol |
| 29 | 5-chloro-2-(6-(1,2,2,6,6-pentamethylpiperidin-4-ylamino)pyridazin-3-yl)phenol |
| 30 | 4-hydroxy-3-(6-(methyl(2,2,6,6-tetramethylpiperidin-4-yl)amino)pyridazin-3-yl)benzonitrile |
| 31 | 3-(6-((2,2,6,6-tetramethylpiperidin-4-yl)oxy)pyridazin-3-yl)naphthalen-2-ol |
| $32^1$ | 2-(6-(methyl(2,2,6,6-tetramethylpiperidin-4-yl)amino)pyridazin-3-yl)-4-(trifluoromethyl)phenol |
| 33 | 2-fluoro-6-(6-(methyl-(2,2,6,6-tetramethylpiperidin-4-yl)-amino)-pyridazin-3-yl)phenol |
| 34 | 3,5-dimethoxy-2-(6-(methyl(2,2,6,6-tetramethylpiperidin-4-yl)amino)pyridazin-3-yl)phenol |
| 35 | 4,5-dimethoxy-2-(6-(methyl(2,2,6,6-tetramethylpiperidin-4-yl)amino)pyridazin-3-yl)phenol |
| 36 | 5-methoxy-2-(6-(methyl(2,2,6,6-tetramethylpiperidin-4-yl)amino)pyridazin-3-yl)phenol |
| 37 | 4,5-difluoro-2-(6-(methyl(2,2,6,6-tetramethylpiperidin-4-yl)amino)pyridazin-3- |

| Cpd | Name |
|---|---|
| | yl)phenol |
| 38 | 5-fluoro-2-(6-(methyl(2,2,6,6-tetramethylpiperidin-4-yl)amino)pyridazin-3-yl)phenol |
| 39 | 3-hydroxy-4-(6-(methyl(2,2,6,6-tetramethylpiperidin-4-yl)amino)pyridazin-3-yl)benzonitrile |
| 40 | 1-allyl-6-(6-(methyl(2,2,6,6-tetramethylpiperidin-4-yl)amino)pyridazin-3-yl)naphthalen-2-ol |
| 41 | 6-(benzo[b]thiophen-2-yl)-N-(1,2,2,6,6-pentamethylpiperidin-4-yl)pyridazin-3-amine |
| 42 | N-allyl-3-hydroxy-4-(6-(methyl(2,2,6,6-tetramethylpiperidin-4-yl)amino)pyridazin-3-yl)benzamide |
| 43 | 2-(6-(methyl(2,2,6,6-tetramethylpiperidin-4-yl)amino)pyridazin-3-yl)-5-(1H-pyrazol-1-yl)phenol |
| 44 | 5-(5-methyl-oxazol-2-yl)-2-(6-(methyl-(2,2,6,6-tetramethylpiperidin-4-yl)-amino)-pyridazin-3-yl)phenol |
| 45 | 5-(4-hydroxymethyl)-1H-pyrazole-1-yl)-2-(6-(methyl(2,2,6,6-tetramethylpiperidin-4-yl)amino)pyridazin-3-yl)phenol |
| 46 | 5-(1H-imidazol-1-yl)-2-(6-(methyl(2,2,6,6-tetramethylpiperidin-4-yl)amino)pyridazin-3-yl)phenol |
| 47 | 5-(4-amino-1H-pyrazole-1-yl)-2-(6-(methyl(2,2,6,6-tetramethylpiperidin-4-yl)amino)pyridazin-3-yl)phenol |
| 48 | 2-(6-(methyl(2,2,6,6-tetramethylpiperidin-4-yl)amino)pyridazin-3-yl)-5-(1H-pyrazol-4-yl)phenol |
| 49 | 5-(3-amino-1H-pyrazol-1-yl)-2-(6-(methyl(2,2,6,6-tetramethylpiperidin-4-yl)amino)pyridazin-3-yl)phenol |
| 50 | 2-(6-(methyl(2,2,6,6-tetramethylpiperidin-4-yl)amino)pyridazin-3-yl)-5-(1-(2-morpholino-ethyl)-1H-pyrazol-4-yl)phenol |
| 51 | 2-(6-(methyl(2,2,6,6-tetramethylpiperidin-4-yl)amino)pyridazin-3-yl)-5-(1-methyl-1H-pyrazol-4-yl)phenol |
| 52 | 5-(5-amino-1H-pyrazol-1-yr)-2-(6-(methyl-(2,2,6,6-tetramethylpiperidin-4-yl)amino)pyridazin-3-yl)phenol |
| 53[1] | 2-(6-(methyl(2,2,6,6-tetramethylpiperidin-4-yl)amino)pyridazin-3-yl)-4-(1H-pyrazol-1-yl)phenol |
| 54 | 2-((6-((2-hydroxy-ethyl)-(2,2,6,6-tetramethylpiperidin-4-yl)-amino)-pyridazin-3-yl)-5-pyrazol-1-yl)phenol |
| 55 | 2-(6-(piperidin-4-yloxy)pyridazin-3-yl)-5-(1H-pyrazol-1-yl)phenol |
| 56 | 2-(6-(((2S,4R,6R)-2,6-dimethylpiperidin-4-yl)oxy)pyridazin-3-yl)-5-(1H-pyrazol-1-yl)phenol |
| 57 | 2-(6-((-2,6-dimethylpiperidin-4-yl)oxy)pyridazin-3-yl)-5-(1H-pyrazol-1-yl)phenol |
| 58 | 5-(1H-pyrazol-1-yl)-2-(6-(pyrrolidin-3-yl-oxy)pyridazin-3-yl)phenol |
| 59 | 2-(6-(((2S,4S)-2-methylpiperidin-4-yl)oxy)pyridazin-3-yl)-5-(1H-pyrazol-1-yl)phenol |
| 60 | (5-(1H-pyrazol-1-yl)-2-(6-(pyrrolidin-3-ylmethoxy)pyridazin-3-yl)phenol |
| 61 | 2-(6-((3-fluoropiperidin-4-yl)oxy)pyridazin-3-yl)-5-(1H-pyrazol-4-yl)phenol |
| 62 | 2-(6-(1,2,2,6,6-pentamethyl-piperidin-4-yl-oxy)-pyridazin-3-yl)-5-(1H-pyrazol-1-yl)phenol |
| 63 | 5-1H-pyrazol-1-yl-2-(6-(2,2,6,6-tetramethylpiperidin-4-yl-oxy)-pyridazin-3-yl)phenol |
| 64 | 5-(1H-pyrazol-4-yl)-2-(6-((2,2,6,6-tetramethylpiperidin-4-yl)oxy)pyridazin-3-yl)phenol |
| 65[1] | 2-(6-piperazin-1-yl-pyridazin-3-yl)-5-(1H-pyrazol-1-yl)phenol |
| 66 | 3-(6-(azetidin-3-ylamino)-pyridazin-3-yl)naphthalen-2-ol |
| 67 | 2-(6-(azetidin-3-ylamino)pyridazin-3-yl)-5-(1H-pyrazol-1-yl)phenol |
| 68 | 2-(6-(3,5-dimethylpiperazin-1-yl)pyridazin-3-yl)-5-(1H-pyrazol-1-yl)phenol |
| 69 | 2-(6-(7-methyl-2,7-diazaspiro[4.4]nonan-2-yl)pyridazin-3-yl)-5-(1H-pyrazol-1-yl)phenol |
| 70 | 2-(6-(1,4-diazepan-1-yl)pyridazin-3-yl)-5-(1H-pyrazol-1-yl)phenol |
| 71 | 2-(6-(4-(2-hydroxyethyl)piperazin-1-yi)pyridazin-3-yl)-5-(1H-pyrazol-1-yl)phenol |
| 72 | 2-(6-(3,6-diazabicyclo[3.2.1]octan-3-yl)pyridazin-3-yl)-5-(1H-pyrazol-1-yl)phenol |
| 73 | 2-(6-(2,7-diazaspiro[3.5]nonan-7-yl)pyridazin-3-yl)-5-(1H-pyrazol-1-yl)phenol |
| 74 | 2-(6-(3-(hydroxymethyl)piperazin-1-yl)pyridazin-3-yl)-5-(1H-pyrazol-1-yl)phenol |
| 75 | 2-(6-(1,7-diazaspiro[4.4]nonan-7-yl)pyridazin-3-yl)-5-(1H-pyrazol-1-yl)phenol |
| 76 | 2-(6-(4-amino-4-methylpiperidin-1-yl)pyridazin-3-yl)-5-(1H-pyrazol-1-yl)phenol |
| 77 | 2-(6-(3-(dimethylamino)piperidin-1-yl)pyridazin-3-yl)-5-(1H-pyrazol-1-yl)phenol |
| 78 | 2-(6-(1, 2,2,6,6-pentamethylpiperidin-4-ylamino)-pyridazin-3-yl)-5-1H-pyrazol-1-yl-phenol |
| 79 | 2-(6-(3,3-dimethylpiperazin-1-yl)pyridazin-3-yl)-5-(1H-pyrazol-1-yl)phenol |
| 80 | 2-(6-(7-(2-hydroxyethyl)-2,7-diazaspiro[4.4]-nonan-2-yl)pyridazin-3-yl)-5-(1H-pyrazol-1-yl)phenol |
| 81 | 2-(6-((3aR,6aS)-hexahydropyrrolo[3,4-c]pyrrol-2(1H)-yl)pyridazin-3-yl)-5-(1H-pyrazol-1-yl)phenol |
| 82[1] | 3-(6-(piperazin-1-yl)pyridazin-3-yl)naphthalene-2,7-diol |
| 83 | 5-(1H-pyrazol-1-yl)-2-(6-(1,2,3,6-tetrahydropyridin-4-yr)pyridazin-3-yl)phenol |
| 84 | 2-(6-piperidin-4-yl-pyridazin-3-yl)-5-1H-pyrazol-1-yl-phenol |
| 85 | 3-(6-(1,2,3,6-tetrahydropyridin-4-yl)pyridazin-3-yl)naphthalen-2-ol |
| 86[1] | 3-(6-(1,2,3,6-tetrahydropyridin-4-yl)pyridazin-3-yl)naphthalene-2,7-diol |
| 87 | 3-(6-(2,2,6,6-tetramethyl-1,2,3,6-tetrahydropyridin-4-yl)pyridazin-3-yl)naphthalene-2,7-diol |
| 88[1] | 3-(6-(1-methyl-1,2,3,6-tetrahydropyridin-4-yl)pyridazin-3-yl)naphthalene-2,7-diol |
| 89[1] | 3-(6-(piperidin-4-yl)pyridazin-3-yl)naphthalene-2,7-diol |
| 90 | 3-(6-((2,2,6,6-tetramethylpiperidin-4-yl)oxy)pyridazin-3-yl)naphthalene-2,7-diol |
| 91 | 3-(6-(methyl(2,2,6,6-tetramethylpiperidin-4-yl)amino)pyridazin-3-yl)naphthalene-2,7- |

| Cpd | Name |
|---|---|
| | diol |
| 92 | 3-(6-((2,2,6,6-tetramethylpiperidin-4-yl)amino)pyridazin-3-yl)naphthalene-2,7-diol |
| 93 | tert-butyl (3-((7-hydroxy-6-(6-(methyl(2,2,6,6-tetramethylpiperidin-4-yl)amino)pyridazin-3-yl)naphthalen-2-yl)oxy)propyl)carbamate |
| 94 | 7-(3-amino-propoxy)-3-(6-(methyl-(2,2,6,6-tetramethylpiperidin-4-yl)-amino)-pyridazin-3-yl)naphthalen-2-ol |
| 95 | N-(3-((7-hydroxy-6-(6-(methyl(2,2,6,6-tetramethylpiperidin-4-yl)amino)pyridazin-3-yl)naphthalen-2-yl)oxy)propyl)acetamide |
| 96 | 7-(3-hydroxypropoxy)-3-(6-(methyl(2,2,6,6-tetramethylpiperidin-4-yl)amino)pyridazin-3-yl)naphthalen-2-ol |
| 97 | 7-(3-methoxypropoxy)-3-(6-(methyl(2,2,6,6-tetramethylpiperidin-4-yl)amino)pyridazin-3-yl)naphthalen-2-ol |
| 98 | 7-(2-morpholinoethoxy)-3-(6-((2,2,6,6-tetramethylpiperidin-4-yl)oxy)pyridazin-3-yl)naphthalen-2-ol |
| 99 | 3-(6-(piperidin-4-ylmethyl)pyridazin-3-yl)naphthalen-2-ol |
| 100 | 5-(1H-pyrazol-1-yl)-2-(6-((2,2,6,6-tetramethylpiperidin-4-yl)methyl)pyridazin-3-yl)phenol |
| 101 | 3-methoxy-2-(6-(methyl(2,2,6-trimethylpiperidin-4-yl)amino)pyridazin-3-yl)-5-(5-methyloxazol-2-yl)phenol |
| 102 | 2-(6-((6S)-6-((S)-1-hydroxyethyl)-2,2-dimethylpiperidin-4-yloxy)pyridazin-3-yl)-5-(1H-pyrazol-1-yl)phenol |
| 103 | 7-hydroxy-6-(6-(methyl(2,2,6,6-tetramethylpiperidin-4-yl)amino)pyridazin-3-yl)-2-naphthonitrile |
| 104 | 3-(6-(methyl(2,2,6,6-tetramethylpiperidin-4-yl)amino)pyridazin-3-yl)-7-(piperidinylmethyl)naphthalen-2-ol |
| 105 | 3-(6-(methyl(2,2,6,6-tetramethylpiperidin-4-yl)amino)pyridazin-3-yl)-7-(pyrrolidinylmethyl)naphthaien-2-ol |
| 106 | 1-bromo-6-(6-(methyl(2,2,6,6-tetramethylpiperidin-4-yl)amino)pyridazin-3-yl)naphthalene-2,7-diol |
| 107 | 1-chloro-6-(6-(methyl(2,2,6,6-tetramethylpiperidin-4-yl)amino)pyridazin-3-yl)naphthalene-2,7-diol |
| 108 | 7-methoxy-3-(6-(methyl(2,2,6,6-tetramethylpiperidin-4-yl)amino)pyridazin-3-yl)naphthalene-2-ol |
| 109 | 7-methoxy-3-(6-(methyl(1,2,2,6,6-pentamethylpiperidin-4-yl)amino)pyridazin-3-yl)naphthalen-2-ol |
| 110 | 7-(3,6-dihydro-2H-pyran-4-yl)-3-(6-(methyl(2,2,6,6-tetramethylpiperidin-4-yl)amino)pyridazin-3-yl)naphthalen-2-ol |
| 111 | 3-(6-(methyl(2,2,6,6-tetramethylpiperidin-4-yl)amino)pyridazin-3-yl)-7-(tetrahydro-2H-pyran-4-yl)naphthalene-2-ol |
| 112 | 7-(difluoromethyl)-3-(6-(methyl(2,2,6,6-tetramethylpiperidin-4-yl)amino)pyridazin-3-yl)naphthalen-2-ol |
| 113 | 7-((4-hydroxy-2-methylbutan-2-yl)oxy)-3-(6-(methyl(2,2,6,6-tetramethylpiperidin-4-yl)amino)pyridazin-3-yl)naphthalen-2-ol |
| 114 | 7-(3-hydroxy-3-methylbutoxy)-3-(6-(methyl(2,2,6,6-tetramethylpiperidin-4-yl)amino)pyridazin-3-yl)naphthalen-2-ol |
| 115 | 2-(6-(methyl(2,2,6,6-tetramethylpiperidin-4-yl)amino)pyridazin-3-yl)-5-(1H-pyrazol-4-yl)benzene-1,3-diol |
| 116 | 3-methoxy-2-(6-(methyl(2,2,6,6-tetramethylpiperidin-4-yl)amino)pyridazin-3-yl)-5-(1H-pyrazol-4-yl)phenol |
| 117 | 5-(1H-pyrazol-4-yl)-2-(6-((2,2,6,6-tetramethylpiperidin-4-yl)amino)pyridazin-3-yl)-3-(trifluoromethoxy)phenol |
| 118 | 2-(6-(methyl(2,2,6,6-tetramethylpiperidin-4-yl)amino)pyridazin-3-yl)-5-(1-methyl-1H-pyrazol-4-yl)-3-(trifluoromethoxy)phenol |
| 119 | 2-(6-(methyl(2,2,6,6-tetramethylpiperidin-4-yl)amino)pyridazin-3-yl)-5-(1H-pyrazol-4-yl)-3-(trifluoromethoxy)phenol |
| 120 | 4-(3-hydroxy-4-(6-(methyl(2,2,6,6-tetramethylpiperidin-4-yl)amino)pyridazin-3-yl)-5-(trifluoromethoxy)phenyl)-1-methylpyridin-2(1H)-one |
| 121 | 3-methoxy-2-(6-(methyl(2,2,6,6-tetramethylpiperidin-4-yl)amino)pyridazin-3-yl)-5-(1-methyl-1H-pyrazol-4-yl)phenol |
| 122 | 3-methoxy-2-(6-(methyl(2,2,6,6-tetramethylpiperidin-4-yl)amino)pyridazin-3-yl)-5-(5,6,7,8-tetrahydroimidazo[1,2-a]pyridin-3-yl)phenol |
| 123 | 3-methoxy-2-(6-(methyl(2,2,6,6-tetramethylpiperidin-4-yl)amino)pyridazin-3-yl)-5-(pyridine-3-yl)phenol |
| 124 | 5-(1-cyclopentyl-1H-pyrazol-4-yl)-3-methoxy-2-(6-(methyl(2,2,6,6-tetramethylpiperidin-4-yl)amino)pyridazin-3-yl)phenol |
| 125 | 3',5-dimethoxy-4-(6-(methyl(2,2,6,6-tetramethylpiperidin-4-yl)amino)pyridazin-3-yl)-(1,1'-biphenyl)-3-ol |
| 126 | 3-(benzyloxy)-2-(6-(methyl(2,2,6,6-tetramethylpiperidin-4-yl)amino)pyridazin-3-yl)-5-(5-methyloxazol-2-yl)phenol |
| 127 | 3-ethoxy-2-(6-(methyl(2,2,6,6-tetramethylpiperidin-4-yl)amino)pyridazin-3-yl)-5-(5-methyloxazol-2-yl)phenol |
| 128 | 3-(cyclopropylmethoxy)-2-(6-(methyl(2,2,6,6-tetramethylpiperidin-4-yl)amino)-pyridazin-3-yl)-5-(5-methyloxazol-2-yl)phenol |
| 129 | 2-methyl-5-(6-(methyl(2,2,6,6-tetramethylpiperidin-4-yl)amino)pyridazin-3-yl)-1H-benzo[d]imidazol-6-ol |
| 130 | 5-chloro-2-(6-(methyl(2,2,6,6-tetramethylpiperidin-4-yl)amino)pyridazin-3-yl)phenol |
| 131 | 5-(1H-pyrazol-1-yl)-2-(6-((2,2,6,6-tetramethylpiperidin-4-yl)amino)pyri dazin-3- |

-continued

| Cpd | Name |
|---|---|
| | yl)phenol |
| 132 | 3-hydroxy-4-(6-((2,2,6,6-tetramethylpiperidin-4-yl)amino)pyridazin-3-yl)benzonitrile |
| 133 | 2-(6-((2,2-dimethylpiperidin-4-yl)oxy)pyridazin-3-yl)-5-(1H-pyrazol-1-yl)phenol |
| 134 | 2-(6-(methyl(2,2,6,6-tetramethylpiperidin-4-yl)amino)pyridazin-3-yl)-4-(1H-pyrazol-4-yl)phenol |
| 135 | 2-(6-(methyl(2,2,6,6-tetramethylpiperidin-4-yl)amino)pyridin-3-yl)-4-(4,5,6,7-tetrahydropyrazolo[1,5-a]pyridin-3-yl)phenol |
| 136 | 2-(6-(methyl(2,2,6,6-tetramethylpiperidin-4-yl)amino)pyridazin-3-yl)-4-(4,5,6,7-tetrahydropyrazolo[1,5-a]pyrazin-3-yl)phenol |
| 137 | 4-(1H-indol-2-yl)-2-(6-(methyl(2,2,6,6-tetramethylpiperidin-4-yl)amino)pyridazin-3-yl)phenol |
| 138 | 4-(cyclopent-1-en-1-yl)-2-(6-(methyl(2,2,6,6-tetramethylpiperidin-4-yl)amino)pyridazin-3-yl)phenol |
| 139 | 2-(6-(methyl(2,2,6,6-tetramethylpiperidin-4-yl)amino)pyridazin-3-yl)-4-(1H-pyrazol-3-yl)phenol |
| 140 | 4-(4-hydroxy-3-(6-(methyl(2,2,6,6-tetramethylpiperidin-4-yl)amino)pyridazin-3-yl)phenyl)pyridin-2-ol |
| 141 | 4-(4-hydroxy-3-(6-((2,2,6,6-tetramethylpiperidin-4-yl)oxy)pyridazin-3-yl)phenyl)-1-methylpyridin-2(1H)-one |
| 142 | 4-(4-hydroxy-3-(6-((2,2,6,6-tetratnethylpiperidin-4-yl)oxy)pyridazin-3-yl)phenyl)pyridin-2-ol |
| 143 | 5-(1H-indazol-7-yl)-2-(6-(methyl(2,2,6,6-tetramethylpiperidin-4-yl)amino)pyridazin-3-yl)phenol |
| 144 | 4-chloro-2-(6-(methyl(2,2,6,6-tetramethylpiperidin-4-yl)amino)pyridazin-3-yl)-5-(1H-pyrazol-4-yl)phenol |
| 145 | 4-fluoro-2-(6-(methyl(2,2,6,6-tetramethylpiperidin-4-yl)amino)pyridazin-3-yl)-5-(1H-pyrazol-4-yl)phenol |
| 146 | 5-fluoro-4-(1H-imidazol-4-yl)-2-(6-(methyl(2,2,6,6-tetramethylpiperidin-4-yl)amino)pyridazin-3-yl)phenol |
| 147 | 5-fluoro-2-(6-(methyl(2,2,6,6-tetramethylpiperidin-4-yl)amino)pyridazin-3-yl)-4-(1H-pyrazol-4-yl)phenol |
| 148 | 5-fluoro-2-(6-(methyl(2,2,6,6-tetramethylpiperidin-4-yl)amino)pyridazin-3-yl)-4-(1H-pyrazol-5-yl)phenol |
| 149 | 6-hydroxy-5-(6-(methyl(2,2,6,6-tetramethylpiperidin-4-yl)amino)pyridazin-3-yl)-2,3-dihydro-1H-inden-1-one |
| 150 | 6-(6-(methyl(2,2,6,6-tetramethylpiperidin-4-yl)amino)pyridazin-3-yl)-1,4-dihydroindeno[1,2-c]-1H-pyrazol-7-ol |
| 151[1] | 6-hydroxy-5-(6-(methyl(2,2,6,6-tetramethylpiperidin-4-yl)amino)pyridazin-3-yl)-2,3-dihydro-1H-inden-1-one oxime |
| 152 | 5-(6-(methyl(2,2,6,6-tetramethylpiperidin-4-yl)amino)pyridazin-3-yl)-2,3-dihydro-1H-indene-1,6-diol |
| 153[1] | 2-amino-6-(6-(methyl(2,2,6,6-tetramethylpiperidin-4-yl)amino)pyridazin-3-yl)-8H-indeno[1,2-d]thiazol-5-ol |
| 154[1] | 9-(6-(methyl(2,2,6,6-tetramethylpiperidin-4-yl)amino)pyridazin-3-yl)-5,6-dihydroimidazo[5,1-a]isoquinolin-8-ol |
| 155 | 4-hydroxy-3-(6-(methyl(2,2,6,6-tetramethylpiperidin-4-yl)amino)pyridazin-3-yl)-N-((1-methyl-1H-pyrazol-4-yl)methyl)benzamide |
| 156 | 4-(4-(hydroxymethyl)-1H-pyrazol-1-yl)-2-(6-(methyl(2,2,6,6-tetramethylpiperidin-4-yl)amino)pyridazin-3-yl)phenol |
| 157 | 5-(1H-pyrazol-4-yl)-2-(6-((2,2,6,6-tetramethylpiperidin-4-yl)methyl)pyridazin-3-yl)phenol |
| 158 | 6-(3-(benzyloxy)isoquinolin-6-yl)-N-methyl-N-(2,2,6,6-tetramethylpiperidin-4-yl)pyridazin-3-amine |
| 159 | 6-(1-(benzyloxy)isoquinolin-7-yl)-N-methyl-N-(2,2,6,6-tetramethylpiperidin-4-yl)pyridazin-3-amine |
| 160[1] | 3-fluoro-5-(2-methoxypyridin-4-yl)-2-(6-(methyl(2,2,6,6-tetramethylpiperidin-4-yl)amino)pyridazin-3-yl)phenol |
| 161[1] | 4-(3-fluoro-5-hydroxy-4-(6-(methyl(2,2,6,6-tetrarnethylpiperidin-4-yl)arnino)pyridazin-3-yl)phenyl)pyridin-2(1H)-one |
| 162[1] | 4-(3-fluoro-5-hydroxy-4-(6-(methyl(2,2,6,6-tetramethylpiperidin-4-yl)amino)pyridazin-3-yl)phenyl)-1-methylpyridin-2(1H)-one |
| 163[1] | 5-(3-fluoro-5-hydroxy-4-(6-(methyl(2,2,6,6-tetramethylpiperidin-4-yl)amino)pyridazin-3-yl)phenyl)-1-methylpyridin-2(1H)-one |
| 164[1] | 3-fluoro-5-(1H-pyrazol-4-yl)-2-(6-((2,2,6,6-tetramethylpiperidin-4-yl)oxy)pyridazin-3-yl)phenol |
| 165[1] | 5-chloro-3-fluoro-2-(6-(methyl(2,2,6,6-tetramethylpiperidin-4-yl)amino)pyridazin-3-yl)phenol |
| 166[1] | 3-fluoro-2-(6-(methyl(2,2,6,6-tetramethylpiperidin-4-yl)amino)pyridazin-3-yl)-5-(1H-pyrazol-4-yl)phenol |
| 167[1] | 3-fluoro-2-(6-(methyl(2,2,6,6-tetramethylpiperidin-4-yl)amino)pyridazin-3-yl)-5-(1-methyl-1H-pyrazol-4-yl)phenol |
| 168 | 5-(5-methoxypyridin-3-yl)-2-(6-(methyl(2,2,6,6-tetramethylpiperidin-4-yl)amino)pyridazin-3-yl)phenol |
| 169 | 5-(3-hydroxy-4-(6-methyl(2,2,6,6-tetramethylpiperidin-4-yl)amino)pyridazin-3-yl)phenyl)pyridin-2-ol |
| 170 | 4-(3-hydroxy-4-(6-methyl(2,2,6,6-tetramethylpiperidin-4-yl)amino)pyridazin-3-yl)phenyl)pyridin-2-ol |

-continued

| Cpd | Name |
|---|---|
| 171 | 5-(6-methoxypyridin-3-yl)-2-(6-(methyl(2,2,6,6-tetramethylpiperidin-4-yl)amino)pyridazin-3-yl)phenol |
| 172 | 5-(3-hydroxy-4-(6-(methyl(2,2,6,6-tetramethylpiperidin-4-yl)amino)pyridazin-3-yl)phenyl)-3-(trifluoromethyl)pyridin-2-ol |
| 173 | 5-(3-hydroxy-4-(6-(methyl(2,2,6,6-tetramethylpiperidin-4-yl)amino)pyridazin-3-yl)phenyl)-1-methylpyridin-2(1H)-one |
| 174 | 4-(3-hydroxy-4-(6-(methyl(2,2,6,6-tetramethylpiperidin-4-yl)amino)pyridazin-3-yl)phenyl)-1-methylpyridin-2(1H)-one |
| 175 | 5-(2-methoxypyridin-4-yl)-2-(6-( (2,2,6,6-tetramethylpiperidin-4-yl)amino)pyridazin-3-yl)phenol |
| 176 | 4-(3-hydroxy-4-(6-((2,2,6,6-tetramethylpiperidin-4-yl)oxy)pyridazin-3-yl)phenyl)pyridin-2-ol |
| 177 | 5-(6-(dimethylamino)pyridin-3-yl)-2-(6-(methyl(2,2,6,6-tetramethylpiperidin-4-yl)amino)pyridazin-3-yl)phenol |
| 178 | 4-(3-hydroxy-4-(6-((2,2,6,6-tetramethylpiperidin-4-yl)oxy)pyridazin-3-yl)phenyl)-1-methylpyridin-2(1H)-one |
| 179 | 2-(6-(methyl(2,2,6,6-tetramethylpiperidin-4-yl)amino)pyridazin-3-yl)-5-(pyrimidin-5-yl)phenol |
| 180 | 5-(3-hydroxy-4-(6-(methyl(2,2,6,6-tetramethylpiperidin-4-yl)amino)pyridazin-3-yl)phenyl)pyridin-3-ol |
| 181 | 1-cyclopropyl-4-(3-hydroxy-4-(6-(methyl(2,2,6,6-tetramethylpiperidin-4-yl)amino)pyridazin-3-yl)phenyl)pyridin-2(1H)-one |
| 182 | 2-(6-(methyl(2,2,6,6-tetramethylpiperidin-4-yl)amino)pyridazin-3-yl)-5-(1,2,3,6-tetrahydropyridin-4-yl)phenol |
| 183 | 5-(cyclopent-1-en-1-yl)-2-(6-(methyl(2,2,6,6-tetramethylpiperidin-4-yl)amino)pyridazin-3-yl)phenol |
| 184 | 5-(3,6-dihydro-2H-pyran-4-yl)-2-(6-(methyl(2,2,6,6-tetramethylpiperidin-4-yl)amino)pyridazin-3-yl)phenol |
| 185 | 5-(imidazo[1,5-a]pyridin-7-yl)-2-(6-(methyl(2,2,6,6-tetramethylpiperidin-4-yl)amino)pyridazin-3-yl)phenol |
| 186 | 5-(imidazo[1,2-a]pyridin-7-yl)-2-(6-(methyl(2,2,6,6-tetramethylpiperidin-4-yl)amino)pyridazin-3-yl)phenol |
| 187 | 2-(6-(methyl(2,2,6,6-tetramethylpiperidin-4-yl)amino)pyridazin-3-yl)-5-(2-methylpyridin-4-yl)phenol |
| 188 | 5-(1H-imidazol-2-yl)-2-(6-(methyl(2,2,6,6-tetramethylpiperidin-4-yl)amino)pyridazin-3-yl)phenol |
| 189 | 5-(1H-imidazol-4-yl)-2-(6-(methyl(2,2,6,6-tetramethylpiperidin-4-yl)amino)pyridazin-3-yl)phenol |
| 190 | 5-(imidazo[1,2-a]pyrazin-3-yl)-2-(6-(tnethyl(2,2,6,6-tetramethylpiperidin-4-yl)amino)pyridazin-3-yl)phenol |
| 191 | 2-(6-(methyl(2,2,6,6-tetratnethylpiperidin-4-yl)amino)pyridazin-3-yl)-5-(5,6,7,8-tetrahydroimidazo[1,2-a]pyrazin-3-yl)phenol |
| 192 | 2-(6-(methyl(2,2,6,6-tetramethylpiperidin-4-yl)amino)pyridazin-3-yl)-5-(4-methyl-1H-imidazol-2-yl)phenol |
| 193 | 2-(6-(methyl(2,2,6,6-tetramethylpiperidin-4-yl)amino)pyridazin-3-yl)-5-(1-methyl-1H-imidazol-4-yl)phenol |
| 194 | 2-(6-(methyl(2,2,6,6-tetramethylpiperidin-4-yl)amino)pyridazin-3-yl)-5-(1-methyl-1H-imidazol-5-yl)phenol |
| 195 | 2-(6-(methyl(2,2,6,6-tetramethylpiperidin-4-yl)amino)pyridazin-3-yl)-5-(4-nitro-1H-imidazol-2-yl)phenol |
| 196 | 2-(6-(methyl(2,2,6,6-tetramethylpiperidin-4-yl)amino)pyridazin-3-yl)-5-(2-methyl-1H-imidazol-4-yl)phenol |
| 197 | 5-(1,2-dimethyl-1H-imidazol-4-yl)-2-(6-(methyl(2,2,6,6-tetramethylpiperidin-4-yl)amino)pyridazin-3-yl)phenol |
| 198 | 1-(3-hydroxy-4-(6-(methyl(2,2,6,6-tetramethylpiperidin-4-y1)amino)pyridazin-3-yl)phenyl)-1H-pyrazole-4-carboxamide |
| 199 | 2-(6-((3aR,6aS)-5-(2-hydroxyethyl)hexahydropyrrolo[3,4-c]pyrrol-2(1H)-yl)pyridazin-3-yl)-5-(1H-pyrazol-4-yl)phenol |
| 200 | 2-(6-((3aR,6aS)-hexahydropyrrolo[3,4-c]pyrrol-2(1H)-yl)pyridazin-3-yl)-5-(1H-pyrazol-4-yl)phenol |
| 201 | 2-(6-((3aR,6aS)-5-methy1Hexahydropyrrolo[3,4-c]pyrrol-2(1H)-yr)pyridazin-3-yl)-5-(1H-pyrazol-4-yl)phenol |
| 202 | 4-(3-hydroxy-4-(6-(5-methy1Hexahydropyrrolo[3,4-c]pyrrol-2(1H)-yl)pyridazin-3-yl)phenyl)-1-methylpyridin-2(1H)-one |
| 203 | 4-(3-hydroxy-4-(6-((3aR,6aR)-1-methy1Hexahydropyrrolo[3,4-b]pyrrol-5(1H)-yl)pyridazin-3-yl)phenyl)-1-methylpyridin-2(1H)-one |
| 204 | 2-(6-(2,7-diazaspiro[4.5]decan-2-yl)pyridazin-3-yl)-5-(1H-pyrazol-4-yl)phenol |
| 205 | 4-(4-(6-(2,7-diazaspiro[4.5]decan-2-yl)pyridazin-3-yl)-3-hydroxyphenyl)-1-methylpyridin-2(1H)-one |
| 206 | 2-(6-(methyl-(2,2,6,6-tetramethylpiperidin-4-yl)-amino)-pyridazin-3-yl)phenol |
| 207 | 6-(6-(methyl(2,2,6,6-tetramethylpiperidin-4-yl)amino)pyridazin-3-yl)quinolin-7-ol |
| 208 | 6-(6-(methyl(1,2,2,6,6-pentamethylpiperidin-4-yl)amino)pyridazin-3-yl)quinolin-7-ol |
| 209 | 6-(6-((3aR,6aS)-5-methylHexahydropyrrolo[3,4-c]pyrrol-2(1H)-yl)pyridazin-3-yl)quinolin-7-ol |
| 210 | 2-methyl-6-(6-(methyl(2,2,6,6-tetramethylpiperidin-4-yl)amino)pyridazin-3-yl)quinolin-7-ol |
| 211 | 7-(6-(methyl(1,2,2,6,6-pentamethylpiperidin-4-yl)amino)pyridazin-3-yl)isoquinolin-6-ol |

| Cpd | Name |
|---|---|
| 212 | 7-(6-(methyl(2,2,6,6-tetramethylpiperidin-4-yl)amino)pyridazin-3-yl)isoquinolin-6-ol |
| 213 | 7-(6-((2,2,6,6-tetramethylpiperidin-4-yl)oxy)pyridazin-3-yl)isoquinoline-6-ol |
| 214 | 7-(6-((3aR,6aS)-5-methylhexahydropyrrolo[3,4-c]pyrrol-2(1H)-yl)pyridazin-3-yl)isoquinolin-6-ol |
| 215 | 1-cyclopropyl-7-(6-(methyl(2,2,6,6-tetramethylpiperidin-4-yl)amino)pyridazin-3-yl)isoquinolin-6-ol |
| 216 | 7-(6-(methyl(2,2,6,6-tetramethylpiperidin-4-yl)amino)pyridazin-3-yl)isoquinoline-1,6-diol |
| 217 | 6-hydroxy-7-(6-(methyl(2,2,6,6-tetramethylpiperidin-4-yl)amino)pyridazin-3-yl)isoquinoline-1-carbonitrile |
| 218 | 6-(6-(methyl(2,2,6,6-tetramethylpiperidin-4-yl)amino)pyridazin-3-yl)isoquinolin-7-ol |
| 219 | 8-(6-(methyl(2,2,6,6-tetramethylpiperidin-4-yl)amino)pyridazin-3-yl)quinolin-7-ol |
| 220 | 6-(6-(methyl(2,2,6,6-tetramethylpiperidin-4-yl)amino)pyridazin-3-yl)quinolin-6-ol |
| 221 | 2-methyl-7-(6-(methyl(2,2,6,6-tetramethylpiperidin-4-yl)amino)pyridazin-3-yl)quinolin-6-ol |
| 222 | 3-chloro-6-(6-(methyl(2,2,6,6-tetramethylpiperidin-4-yl)amino)pyridazin-3-yl)quinolin-7-ol |
| 223 | 3-bromo-6-(6-(methyl(2,2,6,6-tetramethylpiperidin-4-yl)amino)pyridazin-3-yl)quinolin-7-ol |
| 224 | 7-hydroxy-6-(6-(methyl(2,2,6,6-tetramethylpiperidin-4-yl)amino)pyridazin-3-yl)quinoline-3-carbonitrile |
| 225 | 6-(6-(methyl(2,2,6,6-tetramethylpiperidin-4-yl)amino)pyridazin-3-yl)-3-(1-methyl-1H-imidazol-4-yl)quinolin-7-ol |
| 226[1] | 3-(1H-imidazol-1-yl)-6-(6-(methyl(2,2,6,6-tetramethylpiperidin-4-yl)amino)pyridazin-3-yl)quinolin-7-ol |
| 227 | 6-(6-(methyl(2,2,6,6-tetramethylpiperidin-4-yl)amino)pyridazin-3-yl)quinoline-3,7-diol |
| 228 | 3-ethyl-6-(6-(methyl(2,2,6,6-tetramethylpiperidin-4-yr)amino)pyridazin-3-yl)quinolin-7-ol |
| 229 | 3-isopropyl-6-(6-(methyl(2,2,6,6-tetramethylpiperidin-4-yl)amino)pyridazin-3-yl)quinolin-7-ol |
| 230 | 7-hydroxy-6-(6-(methyl(2,2,6,6-tetramethylpiperidin-4-yl)amino)pyridazin-3-yl)quinolm-2(1H)-one |
| 231[1] | 7-hydroxy-1-methyl-6-(6-(methyl(2,2,6,6-tetramethylpiperidin-4-yl)amino)pyridazin-3-yl)quinolin-2(1H)-one |
| 232 | 4-methoxy-2-methyl-6-(6-(methyl(2,2,6,6-tetramethylpiperidin-4-yl)amino)pyridazin-3-yl)quinolin-7-ol |
| 233 | 2-methyl-6-(6-(methyl(2,2,6,6-tetramethylpiperidin-4-yl)amino)pyridazin-3-yl)-4-(pyrrolidin-1-yl)quinolin-7-ol |
| 234 | 2-methyl-6-(6-(methyl(2,2,6,6-tetramethylpiperidin-4-yl)amino)pyridazin-3-yl)-4-morpholinoquinolin-7-ol |
| 235 | 4-(dimethylamino)-2-methyl-6-(6-(methyl(2,2,6,6-tetramethylpiperidin-4-yl)amino)pyridazin-3-yl)quinolin-7-ol |
| 236 | 4-ethoxy-2-methyl-6-(6-(methyl(2,2,6,6-tetramethylpiperidin-4-yl)amino)pyridazin-3-yl)quinolin-7-ol |
| 237 | 2-methyl-6-(6-(methyl(2,2,6,6-tetramethylpiperidin-4-yl)amino)pyridazin-3-yl)-4-(1-methyl-1H-pyrazol-4-yl)quinolin-7-ol |
| 238[1] | 4-methoxy-7-(6-(methyl(2,2,6,6-tetramethylpiperidin-4-yl)amino)pyridazin-3-yl)quinolin-6-ol |
| 239[1] | 7-(6-(methyl(2,2,6,6-tetramethylpiperidin-4-yl)amino)pyridazin-3-yl)quinoxalin-6-ol |
| 240 | 6-(6-(methyl(2,2,6,6-tetramethylpiperidin-4-yl)amino)pyridazin-3-yl)-3-(tetrahydro-2H-pyran-4-yl)quinolin-7-ol |
| 241 | 3-chloro-7-(6-(methyl(2,2,6,6-tetramethylpiperidin-4-yl)amino)pyridazin-3-yl)quinolin-6-ol |
| 242 | 3-bromo-7-(6-(methyl(2,2,6,6-tetramethylpiperidin-4-yl)amino)pyridazin-3-yl)quinolin-6-ol |
| 243 | 3-methyl-7-(6-(methyl(2,2,6,6-tetramethylpiperidin-4-yl)amino)pyridazin-3-yl)quinolin-6-ol |
| 244 | 5-bromo-3-methyl-7-(6-(methyl(2,2,6,6-tetramethylpiperidin-4-yl)amino)pyridazin-3-yl)quinolin-6-ol |
| 245 | 6-hydroxy-1-methyl-7-(6-(methyl(2,2,6,6-tetramethylpiperidin-4-yl)amino)pyridazin-3-yl)quinolin-4(1H)-one |
| 246 | 2,3-dimethyl-7-(6-(methyl(2,2,6,6-tetramethylpiperidin-4-yl)amino)pyridazin-3-yl)quinolin-6-ol |
| 247 | 2-methyl-7-(6-(methyl(2,2,6,6-tetramethylpiperidin-4-yl)amino)pyridazin-3-yl)quinoxalin-6-ol |
| 248 | 3-methyl-7-(6-(methyl(2,2,6,6-tetramethylpiperidin-4-yl)amino)pyridazin-3-yl)quinoxalin-6-ol |
| 249 | 4-methoxy-6-(6-(methyl(2,2,6,6-tetramethylpiperidin-4-yl)amino)pyridazin-3-yl)quinolin-7-ol |
| 250 | 4-(azetidin-1-yl)-2-methyl-6-(6-(methyl(2,2,6,6-tetraniethylpiperidin-4-yl)amino)pyridazin-3-yl)quinolin-7-ol |
| 251 | 7-hydroxy-2-methyl-6-(6-(methyl(2,2,6,6-tetramethylpiperidin-4-yl)amino)pyridazin-3-yl)quinolone-4-carbonitrile |
| 252 | 4-cyclopropyl-2-methyl-6-(6-(methyl(2,2,6,6-tetramethylpiperidin-4-yl)amino)pyridazin-3-yl)-quinolin-7-ol |
| 253 | 4-(3,6-dihydro-2H-pyran-4-yl)-2-methyl-6-(6-(methyl(2,2,6,6-tetramethylpiperidin-4-yl)amino)pyridazin-3-yl)quinolin-7-ol |

| Cpd | Name |
|---|---|
| 254[1] | 2-methyl-6-(6-(methyl(2,2,6,6-tetramethylpiperidin-4-yl)amino)pyridazin-3-yl)-4-(tetrahydro-2H-pyran-4-yl)quinolin-7-ol |
| 255 | 2-methyl-6-(6-(methyl(2,2,6,6-tetramethylpiperidin-4-yl)amino)pyridazin-3-yl)-4-(oxetan-3-yl)quinolin-7-ol |
| 256[1] | 4-(dimethylamino)-6-(6-(methyl(2,2,6,6-tetramethylpiperidin-4-yl)amino)pyridazin-3-yl)-quinolin-7-ol |
| 257 | 7-hydroxy-6-(6-(methyl(2,2,6,6-tetramethylpiperidin-4-yl)amino)pyridazin-3-yl)quinazolin-4(1H)-one |
| 258 | 6-(6-(methyl(2,2,6,6-tetramethylpiperidin-4-yl)amino)pyridazin-3-yl)quinazolin-7-ol |
| 259 | 7-hydroxy-1-methyl-6-(6-(methyl(2,2,6,6-tetramethylpiperidin-4-yl)amino)pyridazin-3-yl)-3,4-dihydroquinolin-2(1H)-one |
| 260 | 2-methyl-6-(6-(methyl(2,2,6,6-tetramethylpiperidin-4-yl)amino)pyridazin-3-yl)quinazolin-7-ol |
| 261 | 7-hydroxy-6-(6-(methyl(2,2,6,6-tetramethylpiperidin-4-yl)amino)pyridazin-3-yl)isoquinoline-1-carbonitrile |
| 262 | 7-hydroxy-6-(6-(methyl(2,2,6,6-tetramethylpiperidin-4-yl)amino)pyridazin-3-yl)quinoline-2-carbonitrile |
| 263 | 6-hydroxy-7-(6-(methyl(2,2,6,6-tetramethylpiperidin-4-yl)amino)pyridazin-3-yl)quinolin-2-carbonitrile |
| 264 | 6-hydroxy-7-(6-(methyl(2,2,6,6-tetramethylpiperidin-4-yl)amino)pyridazin-3-yl)isoquinoline-1-carboxamide |
| 265 | 7-hydroxy-6-(6-(methyl(2,2,6,6-tetramethylpiperidin-4-yl)amino)pyridazin-3-yl)quinolin-2-carboxamide |
| 266 | 6-hydroxy-7-(6-(methyl(2,2,6,6-tetramethylpiperidin-4-yl)amino)pyridazin-3-yl)quinoline-2-carboxamide |
| 267 | methyl 6-hydroxy-7-(6-(methyl(2,2,6,6-tetramethylpiperidin-4-yl)amino)pyridazin-3-yl)quinoline-2-carboxylate |
| 268 | 6-hydroxy-7-(6-(piperazin-1-yl)pyridazin-3-yl)quinoline-2-carbonitrile |
| 269 | 7-hydroxy-6-(6-(piperazin-1-yl)pyridazin-3-yl)quinoline-2-carbonitrile |
| 270 | 7-(6-(piperazin-1-yl)pyridazin-3-yl)isoquinolin-6-ol |
| 271 | 7-(6-(1,2,3,6-tetrahydropyridin-4-yl)pyridazin-3-yl)quinolin-6-ol |
| 272 | 1-methyl-6-(6-(methyl(2,2,6,6-tetramethylpiperidin-4-yl)amino)pyridazin-3-yl)isoquinolin-7-ol |
| 273 | 1-methyl-7-(6-(methyl(2,2,6,6-tetramethylpiperidin-4-yl)amino)pyridazin-3-yl)isoquinolin-6-ol |
| 274 | 1,3-dimethyl-7-(6-(methyl(2,2,6,6-tetramethylpiperidin-4-yl)amino)pyridazin-3-yl)isoquinolin-6-ol |
| 275 | 7-hydroxy-3-methyl-6-(6-(methyl(2,2,6,6-tetramethylpiperidin-4-yl)amino)pyridazin-3-yl)isoquinoline-1-carbonitrile |
| 276 | 1-amino-7-(6-(methyl(2,2,6,6-tetramethylpiperidin-4-yl)amino)pyridazin-3-yl)isoquinolin-6-ol |
| 277 | 7-hydroxy-1,3-dimethyl-6-(6-(methyl(2,2,6,6-tetramethylpiperidin-4-yl)amino)pyridazin-3-yl)quinazoline-2,4(1H,3H)-dione |
| 278 | 6-hydroxy-5-(6-(methyl(2,2,6,6-tetramethylpiperidin-4-yl)amino)pyridazin-3-yl)benzo[d]oxazol-2(3H)-one |
| 279 | 2-methyl-5-(6-(methyl(2,2,6,6-tetramethylpiperidin-4-yl)amino)pyridazin-3-yl)-2H-indazol-6-ol |
| 280 | 1-methyl-5-(6-(methyl(2,2,6,6-tetramethylpiperidin-4-yl)amino)pyridazin-3-yl)-1H-indazol-6-ol |
| 281[1] | 6-hydroxy-2-methyl-7-(6-(methyl(2,2,6,6-tetramethylpiperidin-4-yl)amino)pyridazin-3-yl)isoquinolin-1(2H)-one |
| 282 | 2-ethyl-6-hydroxy-7-(6-((2,2,6,6-tetramethylpiperidin-4-yl)oxy)pyridazin-3-yl)isoquinolin-1(2H)-one |
| 283 | 1-ethoxy-7-(6-(methyl2,2,6,6-tetramethylpiperidin-4-yl)amino)pyridazin-3-yl)isoquinolin-6-ol |
| 284 | 7-(6-((2,2,6,6-tetramethylpiperidin-4-yl)oxy)pyridazin-3-yl)isoquinoline-1,6-diol |
| 285 | 7-(6-(methyl(2,2,6,6-tetramethylpiperidin-4-yl)amino)-pyridazin-3-yl)-3-phenylisoquinolin-6-ol |
| 286 | 3-methyl-7-(6-(methyl(2,2,6,6-tetramethylpiperidin-4-yl)amino)pyridazin-3-yl)isoquinolin-6-ol |
| 287 | 3-cyclopropyl-7-(6-(methyl(2,2,6,6-tetramethylpiperidin-4-yl)amino)pyridazin-3-yl)isoquinolin-6-ol |
| 288 | 3-isopropyl-7-(6-(methyl(2,2,6,6-tetramethylpiperidin-4-yl)amino)pyridazin-3-yl)isoquinolin-6-ol |
| 289 | 3-propyl-7-(6-((2,2,6,6-tetramethylpiperidin-4-yl)oxy)-pyridazin-3-yl)isoquinolin-6-ol |
| 290 | 3-isopropyl-7-(6-((2,2,6,6-tetramethylpiperidin-4-yl)oxy)-pyridazin-3-yl)isoquinolin-6-ol |
| 291 | 3-methyl-7-(6-(piperazin-1-yl)pyridazin-3-yl)isoquinolin-6-ol |
| 292 | 6-(3-(benzyloxy)isoquinolin-6-yl)-N-methyl-N-(2,2,6,6-tetramethylpiperidin-4-yl)pyridazin-3-amine |
| 293 | 3-chloro-6-(6-(methyl(2,2,6,6-tetramethylpiperidin-4-yl)amino)pyridazin-3-yl)quinolin-7-ol |
| 294 | 3-isopropyl-6-(6-(methyl(2,2,6,6-tetramethylpiperidin-4-yl)amino)pyridazin-3-yl)quinolin-7-ol |
| 295 | 3-methyl-7-(6-(methyl(2,2,6,6-tetramethylpiperidin-4-yl)amino)pyridazin-3-yl)quinoxalin-6-ol |
| 296 | 4-chloro-2-methyl-6-(6-(methyl(2,2,6,6-tetramethylpiperidin-4-yl)amino)pyridazin-3- |

| Cpd | Name |
|---|---|
| | yl)quinolin-7-ol |
| 297 | 4-chloro-7-(6-(methyl(2,2,6,6-tetramethylpiperidin-4-yl)amino)pyridazin-3-yl)quinolin-6-ol |
| 300 | 7-(6-(methyl(2,2,6,6-tetramethylpiperidin-4-yl)amino)pyridazin-3-yl)quinolin-6-ol |
| 301 | 5-(2-methoxy-4-(1H-pyrazol-1-yl)phenyl)-N-methyl-N-(2,2,6,6-tetramethylpiperidin-4-yl)-1,3,4-thiadiazol-2-amine |
| 302 | 6-(5-(methyl(2,2,6,6-tetramethylpiperidin-4-yl)amino)-1,3,4-thiadiazol-2-yl)naphthalen-2-ol |
| 303 | 5-(2-methoxyquinolin-3-yl)-N-methyl-N-(2,2,6,6-tetramethylpiperidin-4-yl)-1,3,4-thiadiazol-2-amine |
| 304 | 5-(3-methoxy-naphthalen-2-yl)-N-methyl-N-(2,2,6,6-tetramethylpiperidin-4-yl)-1,3,4-thiadiazol-2-amine |
| 305 | 5-(2-methoxy-4-(1H-pyrazol-1yl)phenyl)-N-(1,2,2,6,6-pentamethylpiperidin-4-yl)-1,3,4-thiadiazol-2-amine |
| 306 | 5-(2-tnethoxy-4-(1-methyl-1H-pyrazol-4-yl)phenyl)-N-methyl-N-(2,2,6,6-tetramethylpiperidin-4-yl)-1,3,4-thiadiazol-2-amine |
| 307 | 5-(2-methoxy-4-(1H-pyrazol-4-yl)phenyl)-N-methyl-N-(2,2,6,6-tetramethylpiperidin-4-yl)-1,3,4-thiadiazol-2-amine |
| 308 | 4-(3-methoxy-4-(5-(methyl(2,2,6,6-tetramethylpiperidin-4-yl)amino)-1,3,4-thiadiazol-2-yl)phenyl)-1-methylpyridin-2(1H)-one |
| 309 | 5-(3-methoxy-4-(5-(methyl(2,2,6,6-tetramethylpiperidin-4-yl)amino)-1,3,4-thiadiazol-2-yl)phenyl)pyridin-2-ol |
| 310 | 5-(3-methoxy-4-(5-(methyl(2,2,6,6-tetramethylpiperidin-4-yl)amino)-1,3,4-thiadiazol-2-yl)phenyl)-1-methylpyridin-2(1H)-one |
| 311 | N-methyl-5-(2-methyl-4-(1-methyl-1H-pyrazol-4-yl)phenyl)-N-(2,2,6,6-tetramethylpiperidin-4-yl)-1,3,4-thiadiazol-2-amine |
| 312 | 1-methyl-4-(4-(5-(methyl(2,2,6,6-tetramethylpiperidin-4-yl)amino)-1,3,4-thiadiazol-2-yl)-3-(trifluoromethoxy)phenyl)pyridin-2(1H)-one |
| 313 | 5-(4-(3,5-dimethyl-1H-pyrazol-4-yl)-2-methoxyphenyl)-N-methyl-N-(2,2,6,6-tetramethylpiperidin-4-yl)-1,3,4-thiadiazol-2-amine |
| 314 | 5-(2-methoxy-4-(1-methyl-1H-pyrazol-4-yl)phenyl)-N-methyl-N-(2,2,6,6-tetramethylpiperidin-4-yl)-1,3,4-thiadiazol-2-amine |
| 315 | 2-(5-(methyl(2,2,6,6-tetramethylpiperidin-4-yl)amino)-1,3,4,-thiadiozol-2-yl-5-(1-methyl-1H-pyrazol-4-yl)phenol |
| 316 | 2-(5-(methyl(2,2,6,6-tetramethylpiperidin-4-yl)amino)-1,3,4,-thiadiozol-2-yl-5-(1H-pyrazol-1-yl)phenol |
| 317 | 5-(3-hydroxy-4-(5-(methyl(2,2,6,6-tetramethylpiperidin-4-yl)amino)-1,3,4-thiadiazol-2-yl)phenyl)-1-methylpyridin-2(1H)-one |
| 318 | 4-(3-hydroxy-4-(5-(methyl(2,2,6,6-tetramethylpiperidin-4-yl)amino)-1,3,4-thiadiazol-2-yl)phenyl)-1-methylpyridin-2(1H)-one |
| 319 | 5-(3-hydroxy-4-(5-(methyl(2,2,6,6-tetramethylpiperidin-4-yl)amino)-1,3,4-thiadiazol-2-yl)phenyl)pyridin-2-ol |
| 320 | 3-(5-(methyl(2,2,6,6-tetramethylpiperidin-4-yl)amino)-1,3,4-thiadiazol-2-yl)naphthalene-2,7-diol |
| 321 | 3-(5-((3aR,6aS)-hexahydropyrrolo[3,4-c]pyrrol-2(1H)-yl)-1,3,4-thiadiazol-2-yl)naphthalene-2,7-diol |
| 322[1] | 3-(5-(methyl(2,2,6,6-tetramethylpiperidin-4-yl)amino)-1,3,4-thiadiazol-2-yl)naphthalen-2-ol |
| 323 | 3-(5-(methyl(2,2,6,6-tetramethylpiperidin-4-yl)amino)-1,3,4-thiadiazol-2-yl)quinolin-2-ol |
| 324 | 2-(5-(methyl(2,2,6,6-tetramethylpiperidin-4-yl)amino)-1,3,4-thiadiazol-2-yl)-4-(1H-pyrazol-1-yl)phenol |
| 325 | 5-(2-chloro-4-(1-methyl-1H-pyrazol-4-yl)phenyl)-N-methyl-N-(2,2,6,6-tetramethylpiperidin-4-yl)-1,3,4-thiadiazol-2-amine |
| 326 | 3-chloro-2-(5-(methyl(2,2,6,6-tetramethylpiperidin-4-yl)amino)-1,3,4-thiadiazol-2-yl)-5-(1-methyl-1H-pyrazol-4-yl)phenol |
| 327 | 5-(2-chloro-4-(1-methyl-1H-pyrazol-4-yl)phenyl)-N-(2,2,6,6-tetramethylpiperidin-4-yl)-l,3,4-thiadiazol-2-amine |
| 328 | 3-methoxy-2-(5-(methyl(2,2,6,6-tetramethylpiperidin-4-yl)amino)-1,3,4-thiadiazol-2-yl)-5-methyloxazol-2-yl)phenol |
| 329 | 2-(2-methoxy-4-(1H-pyrazol-1-yl)phenyl)-5-(1,2,3,6-tetrahydropyridin-4-yl)-1,3,4-thiadiazole |
| 330 | 2-(5-(piperazin-1-yl)-1,3,4-thiadiazol-2-yl)-5-(1H-pyrazol-1-yl)phenol |
| 331 | 5-(7-methoxyquinolin-6-yl)-N-methyl-N-(2,2,6,6-tetramethylpiperidin-4-yl)-1,3,4-thiadiazole-2-amine |
| 332 | 6-(5-(methyl(2,2,6,6-tetramethylpiperidin-4-yl)amino)-1,3,4-thiadiazol-2-yl)quinolin-7-ol |
| 333 | 3-methoxy-4-(5-(methyl(2,2,6,6-tetramethylpiperidin-4-yl)amino)-1,3,4-thiadiazol-2-yl)benzonitrile |
| 334 | 3-fluoro-4-(5-(methyl(2,2,6,6-tetramethylpiperidin-4-yl)amino)-1,3,4-thiadiazol-2-yl)benzonitrile |
| 335 | methyl-3-fluoro-4-(5-(methyl(2,2,6,6-tetramethylpiperidin-4-yl)amino)-1,3,4-thiadiazol-2-yl)benzoate |
| 336 | 5-(2-methoxy-4-(3-(methylamino)-1H-pyrazol-1-yl)phenyl)-N-methyl-N-(2,2,6,6-tetramethylpiperidin-4-yl)-1,3,4-thiadiazol-2-amine |
| 337 | 7-methoxy-6-(5-(methyl(2,2,6,6-tetramethylpiperidin-4-yl)amino)-1,3,4-thiadiazol-2-yl)quinoline-2-carbonitrile |

-continued

| Cpd | Name |
|---|---|
| 338 | 4-(3-methoxy-4-(5-((2,2,6,6-tetramethylpiperidin-4-yl)oxy)-1,3,4-thiadiazol-2-yl)phenyl)-1-methylpyridin-2(1H)-one |
| 339 | 4-(3-chloro-4-(5-(methyl(2,2,6,6-tetramethylpiperidin-4-yl)amino)-1,3,4-thiadiazol-2-yl(phenyl)-1-methylpyridin-2(1H)-one |
| 340 | 5-(2-chloro-4-(1H-pyrazol-4-yl)phenyl)-N-methyl-N-(2,2,6,6-tetramethylpiperidin-4-yl)-1,3,4-thiadiazol-2-amine |
| 341 | 5-(2-chloro-4-(4,5,6,7-tetrahydropyrazolo[1,5-a]pyridin-3-yl)phenyl)-N-methyl-N-(2,2,6,6-tetramethylpiperidin-4-yl)-1,3,4-thiadiazol-2-amine |
| 342[1] | N-methyl-5-(5-(1-methyl-1H-pyrazol-4-yl)pyridin-2-yl)-N-(2,2,6,6-tetramethylpiperidin-4-yl)-1,3,4-thiadiazol-2-amine |
| 343 | 2-(2-chloro-4-(1-methyl-1H-pyrazol-4-yl)phenyl)-5-((2,2,6,6-tetramethylpiperidin-4-yl)oxy-1,3,4-thiadiazole |
| 344 | 5-(2-chloro-4-(6-methoxypyridin-3-yl)phenyl)-N-niethyl-N-(2,2,6,6-tetramethylpiperidin-4-yl)-1,3,4-thiadiazol-2-amine |
| 345 | 5-(4-(6-aminopyridin-3-yl)-2-fluorophenyl)-N-methyl-N-(2,2,6,6-tetramethylpiperidin-4-yl)-1,3,4-thiadiazol-2-amine |
| 346 | 5-(2-fluoro-4-(3-methyl-1H-pyrazol-5-yl)phenyl)-N-methyl-N-(2,2,6,6-tetramethylpiperidin-4-yl)-1,3,4-thiadiazol-2-amine |
| 347 | 5-(2-fluoro-4-(1H-pyrazol-5-yl)phenyl)-N-methyl-N-(2,2,6,6-tetramethylpiperidin-4-yl)-1,3,4-thiadiazol-2-amine |
| 348 | 5-(2,3-difluoro-4-(1H-pyrazol-4-yl)phenyl)-N-methyl-N-(2,2,6,6-tetramethylpiperidin-4-yl)-1,3,4-thiadiazol-2-amine |
| 349 | 5-(2,3-difluoro-4-(1H-pyrazol-5-yl)phenyl)-N-methyl-N-(2,2,6,6-tetramethylpiperidin-4-yl)-1,3,4-thiadiazol-2-amine |
| 350 | 5-(2,5-difluoro-4-(1H-pyrazol-4-yl)phenyl)-N-methyl-N-(2,2,6,6-tetramethylpiperidin-4-yl)-1,3,4-thiadiazol-2-amine |
| 351 | 5-(2,5-difluoro-4-(1H-pyrazol-5-yl)phenyl)-N-methyl-N-(2,2,6,6-tetramethylpiperidin-4-yl)-1,3,4-thiadiazol-2-amine |
| 352 | 5-(2,6-difluoro-4-(1H-pyrazol-4-yl)phenyl)-N-methyl-N-(2,2,6,6-tetramethylpiperidin-4-yl)-1,3,4-thiadiazol-2-amine |
| 353 | 2-(2,5-difluoro-4-(1H-pyrazol-4-yl)phenyl)-5-((3aR,6aS)-hexahydropyrrolo[3,4-c]pyrrol-2(1H)-yl)-1,3,4-thiadiazole |
| 354 | 5-(2-chloro-5-fluoro-4-(1H-pyrazol-4-yl)phenyl)-N-methyl-N-(2,2,6,6-tetramethylpiperidin-4-yl)-1,3,4-thiadiazol-2-amine |
| 355 | 5-(3-fluoro-5-(1H-pyrazol-4-yl)pyridin-2-yl)-N-methyl-N-(2,2,6,6-tetramethylpiperidin-4-yl)-1,3,4-thiadiazol-2-amine |
| 356 | 5-(4-(2-aminopyrimidin-4-yl)-2-chlorophenyl)-N-methyl-N-(2,2,6,6-tetramethylpiperidin-4-yl)-1,3,4-thiadiazol-2-amine |
| 357 | 5-(5-(2-aminopyrimidin-4-yl)-2-chlorophenyl)-N-methyl-N-(2,2,6,6-tetramethylpiperidin-4-yl)-1,3,4-thiadiazol-2-amine |
| 358 | 5-(4-(2,4-dimethylthiazol-5-yl)-2,5-difluorophenyl)-N-methyl-N-(2,2,6,6-tetramethylpiperidin-4-yl)-1,3,4-thiadiazol-2-amine |
| 359 | 5-(4-(2,4-dimethylthiazol-5-yl)-2,3-difluorophenyl)-N-methyl-N-(2,2,6,6-tetramethylpiperidin-4-yl)-1,3,4-thiadiazol-2-amine |
| 360 | 4-(3-hydroxy-4-(5-(methyl(2,2,6,6-tetramethylpiperidin-4-yl)amino)-1,3,4-thiadiazol-2-yl)-5-(trifluoromethoxy)phenyl)-1-methylpyridin-2(1H)-one |
| 361 | 5-(2-fluoro-6-methoxy-4-(1H-pyrazol-4-yl)phenyl)-N-methyl-N-(2,2,6,6-tetramethylpiperidin-4-yl)-1,3,4-thiadiazol-2-amine |
| 362 | 2-(2-fluoro-6-methoxy-4-(1H-pyrazol-4-yl)phenyl)-5-((3aR,6aS)-5-methylHexahydropyrrolo[3,4-c]pyrrol-2(1H)-yl)-1,3,4-thiadiazole |
| 363 | 5-(2,3-difluoro-6-methoxy-4-(1H-pyrazol-4-yl)phenyl)-N-methyl-N-(2,2,6,6-tetramethylpiperidin-4-yl)-1,3,4-thiadiazol-2-amine |
| 364 | 6-methoxy-2-(5-(methyl(2,2,6,6-tetramethylpiperidin-4-yl)amino)-1,3,4-thiadiazol-2-yl)-3,4-dihydroisoquinolin-1-(2H)-one |
| 365 | 5-(2-chloro-4-(1H-pyrazol-1-yl)phenyl)-N-methyl-N-(2,2,6,6-tetramethylpiperidin-4-yl)-1,3,4-thiadiazol-2-amine |
| 366 | 5-(2-chloro-4-(1H-1,2,3-triazol-1-yl)phenyl)-N-methyl-N-(2,2,6,6-tetramethylpiperidin-4-yl)-1,3,4-thiadiazol-2-amine |
| 367 | 5-(2-chloro-4-(2H-1,2,3-triazol-2-yl)phenyl)-N-methyl-N-(2,2,6,6-tetramethylpiperidin-4-yl)-1,3,4-thiadiazol-2-amine |
| 368 | 5-(2-chloro-4-(1H-1,2,4-triazol-1-yl)phenyl)-N-methyl-N-(2,2,6,6-tetramethylpiperidin-4-yl)-1,3,4-thiadiazol-2-amine |
| 369 | 5-(4-(3-amino-1H-pyrazol-1-yl)-2-chlorophenyl)-N-methyl-N-(2,2,6,6-tetramethylpiperidin-4-yl)-1,3,4-thiadiazol-2-amine |
| 370 | 2-(2-chloro-4-(1H-imidazol-1-yl)phenyl)-5-((3aR,6aS)-5-methylhexahydropyrrolo[3,4c]pyrrol-2(1H)-yl)-1,3,4-thiadiazole |
| 371 | 5-(2-chloro-4-(1H-imidazol-1-yl)phenyl)-N-methyl-N-(2,2,6,6-tetramethylpiperidin-4-yl)-1,3,4-thiadiazol-2-amine |
| 372 | 5-(2-fluoro-4-(1H-imidazol-1-yl)phenyl)-N-methyl-N-(2,2,6,6-tetramethylpiperidin-4-yl)-1,3,4-thiadiazol-2-amine |
| 373 | 5-(2-methoxy-4-(1H-pyrazol-5-yl)phenyl)-N-methyl-N-(2,2,6,6-tetramethylpiperidin-4-yl)-1,3,4-thiadiazol-2-amine |
| 374 | 5-(4-(2,4-dimethylthiazol-5-yl)-2-methoxyphenyl)-N-methyl-N-(2,2,6,6-tetramethylpiperidin-4-yl)-1,3,4-thiadiazol-2-amine |
| 375 | 5-(2-methoxy-4-(pyridin-3-yl)phenyl)-N-methyl-N-(2,2,6,6-tetramethylpiperidin-4-yl)-1,3,4-thiadiazol-2-amine |
| 376 | 5-(2-fluoro-4-(1H-pyrazol-4-yl)phenyl)-N-methyl-N-(2,2,6,6-tetramethylpiperidin-4- |

| Cpd | Name |
|---|---|
| | yl)-1,3,4-thiadiazol-2-amine |
| 377 | 5-(2-methoxy-4-(2-methoxypyridin-4-yl)phenyl)-N-methyl-N-(2,2,6,6-tetramethylpiperidin-4-yl)-1,3,4-thiadiazol-2-amine |
| 378 | 5-(2-methoxy-4-(6-methoxypyridin-3-yl)phenyl)-N-methyl-N-(2,2,6,6-tetramethylpiperidin-4-yl)-1,3,4-thiadiazol-2-amine |
| 379 | 2-(2-chloro-4-(1-methyl-1H-pyrazol-4-yl)phenyl)-5-((3aR,6aS)-5-methylhexahydropyrrolo[3,4-c]pyrrol-2(1H)-yl(-1,3,4-thiadiazole |
| 380 | 2-(2-chloro-4-(1H-pyrazol-4-yl)phenyl)-5-((3aR,6aS)-5-methylhexahydropyrrolo[3,4-c]pyrrol-2(1H)-yl(-1,3,4-thiadiazole |
| 381 | 2-(2-chloro-4-(1H-pyrazol-4-yl)phenyl)-5-((3aR,6aR)-1-methylhexahydropyrrolo[3,4-b]pyrrol-5(1H)-yl)-1,3,4-thiadiazole |
| 382 | 1-(4-(5-(2-chloro-4-(1H-pyrazol-4-yl)phenyl)-1,3,4-thiadiazol-2-yl)morpholin-2-yl)-N,N-dimethylmethanamine |
| 383 | 2-(2-chloro-4-(1H-pyrazol-4-yl)phenyl)-5-(2-methyl-2,7-diazaspiro[4.5]decan-7-yl(-1,3,4-thiadiazole |
| 384 | 2-(2-fluoro-4-(1H-pyrazol-4-yl)phenyl)-5-((3aR,6aS)-5-methylhexahydropyrrolo[3,4-c]pyrrol-2(1H)-yl)-1,3,4-thiadiazole |
| 385 | 2-(2-methoxy-4-(1-methyl-1H-pyrazol-4-yl)phenyl)-5-(2,6-diazaspiro[3.5]nonan-2-yl)-1,3,4-thiadiazole |
| 386 | 2-(2-methoxy-4-(1-methyl-1H-pyrazol-4-yl)phenyl)-5-(2,7-diazaspiro[3.5]nonan-2-yl(-1,3,4-thiadiazole |
| 387 | 2-(5-(methyl(2,2,6,6-tetramethylpiperidin-4-yl)amino)-1,3,4-thiadiazol-2-yl)-5-(1H-pyrazol-1-yl)phenol |
| 388 | 5-(3-chloro-4-(5-(methyl(2,2,6,6-tetramethylpiperidin-4-yl)amino)-1,3,4-thiadiazol-2-yl(phenyl(pyridin-2(1H)-one |
| 389 | 2-(5-(methyl(2,2,6,6-tetramethylpiperidin-4-yl)amino)-1,3,4-thiadiazol-2-yl)-5-(3-(methylamino)-1H-pyrazol-1-yl)phenol |
| 390 | 3-fluoro-2-(5-(methyl(2,2,6,6-tetramethylpiperidin-4-yl)amino)-1,3,4-thiadiazol-2-yl)-5-(1H-pyrazol-4-yl)phenol |
| 391 | 3,4-difluoro-2-(5-(methyl(2,2,6,6-tetramethylpiperidin-4-yl)amino)-1,3,4-thiadiazol-2-yl)-5-(1H-pyrazol-4-yl)phenol |
| 392 | 6-hydroxy-5-(5-(methyl(2,2,6,6-tetramethylpiperidin-4-yl)amino)-1,3,4-thiadiazol-2-yl)-2,3-dihydro-1H-inden-1-one |
| 393 | 2-(5-(methyl(2,2,6,6-tetramethylpiperidin-4-yl)amino)-1,3,4-thiadiazol-2-yl)-5-(1H-pyrazol-4-yl)phenol |
| 394 | 2-(5-(2,6-diazaspiro[3.5]nonan-2-yl)-1,3,4-thiadiazol-2-yl)-5-(1-methyl-1H-pyrazol-4-yl)phenol |
| 395 | 2-(5-(2,7-diazaspiro[3.5]nonan-2-yl)-1,3,4-thiadiazol-2-yl)-5-(1-methyl-1H-pyrazol-4-yl)phenol |
| 396[1] | 3-fluoro-2-(5-((3aR,6aS)-hexahydropyrrolo[3,4-c]pyrrol-2(1H)-yl)-1,3,4-thiadiazol-2-yl)-5-(1H-pyrazol-4-yl)phenol |
| 397 | 3-chloro-2-(5-(methyl(2,2,6,6-tetramethylpiperidin-4-yl)amino)-1,3,4-thiadiazol-2-yl)-5-(1H-pyrazol-4-yl(phenol |
| 398 | 2-(2-methoxy-4-(1H-pyrazol-1-yl)phenyl)-5-((2,2,6,6-tetramethylpiperidin-4-yl)methyl)-1,3,4-thiadiazole |
| 399 | 2-(2,3-difluoro-4-(1H-pyrazol-4-yl)phenyl)-5-(2,7-diazaspiro[3.5]nonan-2-yl)-1,3,4-thiadiazole |
| 400 | 2-(5-(2,7-diazaspiro[3.5]nonan-2-yl)-1,3,4-thiadiazol-2-yl)-3-fluoro-5-(1H-pyrazol-4-yl)phenol |
| 401 | 4-methoxy-1-methyl-3-(5-(methyl(2,2,6,6-tetramethylpiperidin-4-yl)amino)-1,3,4-thiadiazol-2-yl)quinolin-2(1H)-one |
| 402 | 4-hydroxy-1-methyl-3-(5-(methyl(2,2,6,6-tetramethylpiperidin-4-yl)amino)-1,3,4-thiadiazol-2-yl)quinolin-2(1H)-one |
| 403 | 3-(5-(methyl(2,2,6,6-tetramethylpiperidin-4-yl)amino)-1,3,4-thiadiazol-2-yl)quinolin-2(1H)-one |
| 404 | 1-methyl-3-(5-(methyl(2,2,6,6-tetramethylpiperidin-4-yl)amino)-1,3,4-thiadiazol-2-yl)quinolin-2(1H)-one |
| 405[1] | 2-(2-chloro-4-(1H-pyrazol-4-yl)phenyl)-5-((3aR,6aS)-hexahydropyrrolo[3,4-c]pyrrol-2(1H)-yl)-1,3,4-thiadiazole |
| 406[1] | 2-(2-chloro-4-(1H-pyrazol-4-yl)phenyl)-5-(2,7-diazaspiro[4.5]decan-2-yl)-1,3,4-thiadiazole |
| 407[1] | (R)-(4-(5-(2-chloro-4-(1H-pyrazol-4-yl)phenyl)-1,3,4-thiadiazol-2-yl)piperazin-2-yl)methanol |
| 408 | 2-(5-(methyl(2,2,6,6-tetramethylpiperidin-4-yl)amino)-1,3,4-thiadiazol-2-yl)benzo[b]thiophene-5-carbonitrile |
| 409 | 5-(3-chlorobenzo[b]thiophen-2-yl)-N-methyl-N-(2,2,6,6-tetramethylpiperidin-4-yl)-1,3,4-thiadiazol-2-amine |
| 410 | 5-(2-methoxy-4-(1H-pyrazol-4-yl)phenyl)-N-methyl-N-(2,2,6,6-tetramethylpiperidin-4-yl)-1,3,4-thiadiazol-2-amine |
| 411[1] | 2-{6-[(1R,5S)-8-azabicyclo[3.2.1]oct-3-yl(methyl)amino]pyridazin-3-yl}-5-(1H-pyrazol-4-yl)phenol |
| 412[1] | 2-[6-((1R,5S)-8-azabicyclo[3.2.1]oct-3-ylamino)pyridazin-3-yl]-5-(1H-pyrazol-4-yl)phenol |
| 413[1] | 5-(1H-pyrazol-4-yl)-2-{6-[(2,2,6,6-tetramethylpiperidin-4-yl)amino]pyridazin-3-yl}phenol |
| 414 | 5-(1-methyl-1H-pyrazol-4-yl)-2-{6-[(2,2,6,6-tetramethylpiperidin-4-yl)oxy]pyridazin-3-yl}phenol |

-continued

| Cpd | Name |
|---|---|
| 415[1] | 2-[6-((1R,5S)-8-azabicyclo[3.2.1]oct-3-yloxy)pyridazin-3-yl]-5-(1H-pyrazol-4-yl)phenol |
| 416 | 5-(5-methyl-1H-pyrazol-4-yl)-2-{6-[methyl(2,2,6,6-tetramethylpiperidin-4-yl)amino]pyridazin-3-yl}phenol |
| 417 | 5-(1H-imidazol-1-yl)-2-{6-[(2,2,6,6-tetramethylpiperidin-4-yl)oxy]pyridazin-3-yl}phenol |
| 418 | 5-(5-methyl-1H-pyrazol-4-yl)-2-{6-[(2,2,6,6-tetramethylpiperidin-4-yl)oxy]pyridazin-3-yl}phenol |
| 419[1] | 2-{6-[methyl(2,2,6,6-tetramethylpiperidin-4-yl)amino]pyridazin-3-yl}-5-(4-nitro-1H-pyrazol-1-yl)phenol |
| 420 | 6-[2-methoxy-4-(4-nitro-1H-pyrazol-l-yl)phenyl]-N-methyl-N-(2,2,6,6-tetramethylpiperidin-4-yl)pyridazin-3-amine |
| 421 | 5-(4-amino-1H-pyrazol-1-yl)-2-{6-[(2,2,6,6-tetramethylpiperidin-4-yl)oxy]pyridazin-3-yl}phenol |
| 422[1] | 2-[6-(1-methyl-1,2,3,6-tetrahydropyridin-4-yl)pyridazin-3-yl]-5-(1H-pyrazol-4-yl)phenol |
| 423 | 5-(4-nitro-1H-pyrazol-1-yl)-2-{6-[(2,2,6,6-tetramethylpiperidin-4-yl)oxy]pyridazin-3-yl}phenol |
| 424[1] | 5-(1H-pyrazol-4-yl)-2-[6-(1,2,3,6-tetrahydropyridin-4-yl)pyridazin-3-yl]phenol |
| 425[1] | 2-[6-(1-ethyl-1,2,3,6-tetrahydropyridin-4-yl)pyridazin-3-yl]-5-(1H-pyrazol-4-yl)phenol |
| 426[1] | 2-{6-[methyl(piperidin-4-yl)amino]pyridazin-3-yl}-5-(1H-pyrazol-4-yl)phenol |
| 427[1] | 2-[6-(piperidin-4-ylamino)pyridazin-3-yl]-5-(1H-pyrazol-4-yl)phenol |
| 428 | 6-[2,5-difluoro-4-(1H-pyrazol-4-yl)phenyl]-N-methyl-N-(2,2,6,6-tetramethylpiperidin-4-yl)pyridazin-3-amine |
| 429[1] | 2-[6-(8-azabicyclo[3.2.1]oct-2-en-3-yl)pyridazin-3-yl]-5-(1H-pyrazol-4-yl)phenol |
| 430[1] | 6-[2,3-difluoro-4-(1H-pyrazol-4-yl)phenyl]-N-methyl-N-(2,2,6,6-tetramethylpiperidin-4-yl)pyridazin-3-amine |
| 431[1] | 3-[2,5-difluoro-4-(1H-pyrazol-4-yl)phenyl]-6-[(2,2,6,6-tetramethylpiperidin-4-yl)oxy]pyridazine |
| 432 | 2-[6-(piperidin-4-yloxy)pyridazin-3-yl]-5-(1H-pyrazol-4-yl)phenol |
| 433[1] | 2-{6-[(1R,5S)-8-azabicyclo[3.2.1]oct-3-ylamino]pyridazin-3-yl(-5-(1H-pyrazol-4-yl)phenol |
| 434[1] | 6-[2-methoxy-6-(1H-pyrazol-4-yl)pyridin-3-yl]-N-methyl-N-(2,2,6,6-tetramethylpiperidin-4-yl)pyridazin-3-amine |
| 435 | 3-[4-(1H-pyrazol-4-yl)phenyl]-6-[(2,2,6,6-tetramethylpiperidin-4-yl)oxy]pyridazine |
| 436[1] | 2-{6-[(2,6-dimethylpiperidin-4-yl)oxy]pyridazin-3-yl}-5-(1H-pyrazol-4-yl)phenol |
| 437[1] | 3-[2-fluoro-4-(1H-pyrazol-4-yl)phenyl]-6-[(2,2,6,6-tetramethylpiperidin-4-yl)oxy]pyridazine |
| 438 | 3-[4-(1-methyl-1H-pyrazol-4-yl)thiophen-2-yl]-6-[(2,2,6,6-tetramethylpiperidin-4-yl)oxy]pyridazine |
| 439[1] | 2-[6-(2,7-diazaspiro[3.5]non-2-yl)pyridazin-3-yl]-5-(1H-pyrazol-4-yl)phenol |
| 440 | 3-fluoro-4-{6-[methyl(2,2,6,6-tetramethylpiperidin-4-yl)amino]pyridazin-3-yl}phenol |
| 441 | 2-{6-[(2,6-dimethylpiperidin-4-yl)oxy]pyridazin-3-yl}-5-(1H-pyrazol-1-yl)phenol |
| 442 | N-methyl-6-(2-methyl-2H-indazol-5-yl)-N-(2,2,6,6-tetramethylpiperidin-4-yl)pyridazin-3-amine |
| 443 | 2-methyl-5-{6-[(2,2,6,6-tetramethylpiperidin-4-yl)oxy]pyridazin-3-yl}-2H-indazole |
| 444 | 3-(4-chloro-2-methoxyphenyl)-6-[(2,2,6,6-tetramethylpiperidin-4-yl)oxy]pyridazine |
| 445 | N-methyl-6-(2-methylpyrazolo[1,5-a]pyridin-3-yl)-N-(2,2,6,6-tetramethylpiperidin-4-yl)pyridazin-3-amine |
| 446 | 6-{6-[(2,2,6,6-tetramethylpiperidin-4-yl(oxy)pyridazin-3-yl}imidazo[1,2-a]pyridine |
| 447 | 3-[2-methoxy-4-(1H-pyrazol-1-yl)phenyl]-6-[(2,2,6,6-tetramethylpiperidin-4-yl(oxy)pyridazine |
| 448[1] | 3-[5-(1H-pyrazol-4-yl)thiophen-2-yl]-6-[(2,2,6,6-tetramethylpiperidin-4-yl)oxy]pyridazine |
| 449 | 3-[5-(1-methyl-1H-pyrazol-4-yl)thiophen-2-yl]-6-[(2,2,6,6-tetramethylpiperidin-4-yl(oxy)pyridazine |
| 450[1] | 3-[4-(1H-pyrazol-4-yl)thiophen-2-yl]-6-[(2,2,6,6-tetramethylpiperidin-4-yl)oxy]pyridazine |
| 451 | 5-(3,5-dimethyl-1H-pyrazol-4-yl)-2-{6-[(2,2,6,6-tetramethylpiperidin-4-yl)oxy]pyridazin-3-yl(phenol |
| 452 | 6-[2-fluoro-4-(1H-pyrazol-4-yl)phenyl]-N-methyl-N-(2,2,6,6-tetramethylpiperidin-4-yl)pyridazin-3-amine |
| 453 | 3-methoxy-4-{6-[(2,2,6,6-tetramethylpiperidin-4-yl)oxy]pyridazin-3-yl}phenol |
| 454 | 3-[2-methoxy-4-(4-nitro-1H-pyrazol-1-yl)phenyl]-6-[(2,2,6,6-tetramethylpiperidin-4-yl(oxy)pyridazine |
| 455 | 4-{6-[(2,2,6,6-tetramethylpiperidin-4-yl)oxy]pyridazin-3-yl}benzene-1,3-diol |
| 456[1] | 6-[2-chloro-4-(1H-pyrazol-4-yl)phenyl]-N-methyl-N-(2,2,6,6-tetramethylpiperidin-4-yl)pyridazin-3-amine |
| 457 | 2-(1H-pyrazol-4-yl)-4-{6-[(2,2,6,6-tetramethylpiperidin-4-yl)oxy]pyridazin-3-yl}pyrimidin-5-amine |
| 458[1] | 3-[2,6-difluoro-4-(1H-pyrazol-4-yl)phenyl]-6-[(2,2,6,6-tetramethylpiperidin-4-yl)oxy]pyridazine |
| 459 | 2-[6-(2,6-diazaspiro[3.4]oct-2-yl)pyridazin-3-yl]-5-(1H-pyrazol-4-yl)phenol |
| 460[1] | 3-{6-[methyl(2,2,6,6-tetramethylpiperidin-4-yl)amino]pyridazin-3-yl}-6-(1H-pyrazol-4-yl)pyridin-2-ol |
| 461 | 6-(1H-pyrazol-4-yl)-3-{6-[(2,2,6,6-tetramethylpiperidin-4-yl)oxy]pyridazin-3-yl}pyridin-2-ol |

| Cpd | Name |
|---|---|
| 462[1] | N,2,2,6,6-pentamethyl-N-{5-[3-(1H-pyrazol-4-yl)phenoxy]-1,3,4-thiadiazol-2-yl}piperidin-4-amine |
| 463[1] | N,2,2,6,6-pentamethyl-N-{5-[4-(1H-pyrazol-4-yl(phenoxy)-1,3,4-thiadiazol-2-yl}piperidin-4-amine |
| 464[1] | 3-[2-(difluoromethyl)-4-(1H-pyrazol-4-yl)phenyl]-6-[(2,2,6,6-tetramethylpiperidin-4-yl)oxy]pyridazine and |
| 465[1] | 6-[2-(difluoromethyl)-4-(1H-pyrazol-4-yl)phenyl]-N-methyl-N-(2,2,6,6-tetramethylpiperidin-4-yl)pyridazin-3-amine | wherein a form of the compound is selected from the group consisting of a prodrug, salt, hydrate, solvate, clathrate, isotopologue, racemate, enantiomer, diastereomer, stereoisomer, polymorph and tautomer form thereof.

In another aspect, the compound of Formula (I) or a form thereof used in a method disclosed herein is a compound selected from the group consisting of:

| Cpd | Name |
|---|---|
| 411[1] | 2-{6-[(1R,5S)-8-azabicyclo[3.2.1]oct-3-yl(methyl)amino]pyridazin-3-yl-5-(1H-pyrazol-4-yl)phenol |
| 412[1] | 2-[6-((1R,5S)-8-azabicyclo[3.2.1]oct-3-ylamino)pyridazin-3-yl]-5-(1H-pyrazol-4-yl)phenol |
| 413[1] | 5-(1H-pyrazol-4-yl)-2-{6-[(2,2,6,6-tetramethylpiperidin-4-yl)amino]pyridazin-3-yl}phenol |
| 414 | 5-(1-methyl-1H-pyrazol-4-yl)-2-{6-[(2,2,6,6-tetramethylpiperidin-4-yl)oxy]pyridazin-3-yl}phenol |
| 415[1] | 2-[6-((1R,5S)-8-azabicyclo[3.2.1]oct-3-yloxy)pyridazin-3-yl]-5-(1H-pyrazol-4-yl)phenol |
| 416 | 5-(5-methyl-1H-pyrazol-4-yl)-2-{6-[methyl(2,2,6,6-tetramethylpiperidin-4-yl)amino]pyridazin-3-yl}phenol |
| 417 | 5-(1H-imidazol-1-yl)-2-{6-[(2,2,6,6-tetramethylpiperidin-4-yl)oxy]pyridazin-3-yl}phenol |
| 418 | 5-(5-methyl-1H-pyrazol-4-yl)-2-{6-[(2,2,6,6-tetramethylpiperidin-4-yl)oxy]pyridazin-3-yl}phenol |
| 419[1] | 2-{6-[methyl(2,2,6,6-tetramethylpiperidin-4-yl)amino]pyridazin-3-yl}-5-(4-nitro-1H-pyrazol-1-yl)phenol |
| 420 | 6-[2-methoxy-4-(4-nitro-1H-pyrazol-1-yl)phenyl]-N-methyl-N-(2,2,6,6-tetramethylpiperidin-4-yl)pyridazin-3-amine |
| 421 | 5-(4-amino-1H-pyrazol-1-yl)-2-[6-[(2,2,6,6-tetramethylpiperidin-4-yl)oxy]pyridazin-3-yl}phenol |
| 422[1] | 2-[6-(1-methyl-1,2,3,6-tetrahydropyridin-4-yl)pyridazin-3-yl]-5-(1H-pyrazol-4-yl)phenol |
| 423 | 5-(4-nitro-1H-pyrazol-1-yl)-2-{6-[(2,2,6,6-tetramethylpiperidin-4-yl)oxy]pyridazin-3-yl}phenol |
| 424[1] | 5-(1H-pyrazol-4-yl)-2-[6-(1,2,3,6-tetrahydropyridin-4-yl)pyridazin-3-yl]phenol |
| 425[1] | 2-[6-(1-ethyl-1,2,3,6-tetrahydropyridin-4-yl)pyridazin-3-yl]-5-(1H-pyrazol-4-yl)phenol |
| 426[1] | 2-{6-[methyl(piperidin-4-yl)amino]pyridazin-3-yl}-5-(1H-pyrazol-4-yl)phenol |
| 427[1] | 2-[6-(piperidin-4-ylamino)pyridazin-3-yl]-5-(1H-pyrazol-4-yl)phenol |
| 428[1] | 6-[2,5-difluoro-4-(1H-pyrazol-4-yl)phenyl]-N-methyl-N-(2,2,6,6-tetramethylpiperidin-4-yl)pyridazin-3-amine |
| 429[1] | 2-[6-(8-azabicyclo[3.2.1]oct-2-en-3-yl)pyridazin-3-yl]-5-(1H-pyrazol-4-yl)phenol |
| 430[1] | 6-[2,3-difluoro-4-(1H-pyrazol-4-yl)phenyl]-N-methyl-N-(2,2,6,6-tetramethylpiperidin-4-yl)pyridazin-3-amine |
| 431[1] | 3-[2,5-difluoro-4-(1H-pyrazol-4-yl)phenyl]-6-[(2,2,6,6-tetramethylpiperidin-4-yl)oxy]pyridazine |
| 432 | 2-[6-(piperidin-4-yloxy)pyridazin-3-yl]-5-(1H-pyrazol-4-yl)phenol |
| 433[1] | 2-{6-[(1R,5S)-8-azabicyclo[3.2.1]oct-3-ylamino]pyridazin-3-yl}-5-(1H-pyrazol-4-yl)phenol |
| 434[1] | 6-[2-methoxy-6-(1H-pyrazol-4-yl)pyridin-3-yl]-N-methyl-N-(2,2,6,6-tetramethylpiperidin-4-yl)pyridazin-3-amine |
| 435 | 3-[4-(1H-pyrazol-4-yl)phenyl]-6-[(2,2,6,6-tetramethylpiperidin-4-yl)oxy]pyridazine |
| 436[1] | 2-{6-[(2,6-dimethylpiperidin-4-yl)oxy]pyridazin-3-yl}-5-(1H-pyrazol-4-yl)phenol |
| 437[1] | 3-[2-fluoro-4-(1H-pyrazol-4-yl)phenyl]-6-[(2,2,6,6-tetramethylpiperidin-4-yl)oxy]pyridazine |
| 438 | 3-[4-(1-methyl-1H-pyrazol-4-yl)thiophen-2-yl]-6-[(2,2,6,6-tetramethylpiperidin-4-yl)oxy]pyridazine |
| 439[1] | 2-[6-(2,7-diazaspiro[3.5]non-2-yl)pyridazin-3-yl]-5-(1H-pyrazol-4-yl)phenol |
| 440 | 3-fluoro-4-{6-[methyl(2,2,6,6-tetramethylpiperidin-4-yl)amino]pyridazin-3-yl}phenol |
| 441 | 2-{6-[(2,6-dimethylpiperidin-4-yl)oxy]pyridazin-3-yl}-5-(1H-pyrazol-1-yl)phenol |
| 442 | N-methyl-6-(2-methyl-2H-indazol-5-yl)-N-(2,2,6,6-tetramethylpiperidin-4-yl)pyridazin-3-amine |
| 443 | 2-methyl-5-{6-[(2,2,6,6-tetramethylpiperidin-4-yl)oxy]pyridazin-3-yl}-2H-indazole |
| 444 | 3-(4-chloro-2-methoxyphenyl)-6-[(2,2,6,6-tetramethylpiperidin-4-yl)oxy]pyridazine |
| 445 | N-methyl-6-(2-methylpyrazolo[1,5-a]pyridin-3-yl)-N-(2,2,6,6-tetramethylpiperidin-4-yl)pyridazin-3-amine |
| 446 | 6-{6-[(2,2,6,6-tetramethylpiperidin-4-yl)oxy]pyridazin-3-yl}imidazo[1,2-a]pyridine |

| Cpd | Name |
|---|---|
| 447 | 3-[2-methoxy-4-(1H-pyrazol-1-yl)phenyl]-6-[(2,2,6,6-tetramethylpiperidin-4-yl)oxy]pyridazine |
| 448[1] | 3-[5-(1H-pyrazol-4-yl)thiophen-2-yl]-6-[(2,2,6,6-tetramethylpiperidin-4-yl)oxy]pyridazine |
| 449 | 3-[5-(1-methyl-1H-pyrazol-4-yl)thiophen-2-yl]-6-[(2,2,6,6-tetramethylpiperidin-4-yl)oxy]pyridazine |
| 450[1] | 3-[4-(1H-pyrazol-4-yl)thiophen-2-yl]-6-[(2,2,6,6-tetramethylpiperidin-4-yl)oxy]pyridazine |
| 451 | 5-(3,5-dimethyl-1H-pyrazol-4-yl)-2-{6-[(2,2,6,6-tetramethylpiperidin-4-yl)oxy]pyridazin-3-yl}phenol |
| 452 | 6-[2-fluoro-4-(1H-pyrazol-4-yl)phenyl]-N-methyl-N-(2,2,6,6-tetramethylpiperidin-4-yl)pyridazin-3-amine |
| 453 | 3-methoxy-4-{6-[(2,2,6,6-tetramethylpiperidin-4-yl)oxy]pyridazin-3-yl}phenol |
| 454 | 3-[2-methoxy-4-(4-nitro-1H-pyrazol-1-yl)phenyl]-6-[(2,2,6,6-tetramethylpiperidin-4-yl)oxy]pyridazine |
| 455 | 4-{6-[(2,2,6,6-tetramethylpiperidin-4-yl)oxy]pyridazin-3-yl}benzene-1,3-diol |
| 456[1] | 6-[2-chloro-4-(1H-pyrazol-4-yl)phenyl]-N-methyl-N-(2,2,6,6-tetramethylpiperidin-4-yl)pyridazin-3-amine |
| 457 | 2-(1H-pyrazol-4-yl)-4-{6-[(2,2,6,6-tetramethylpiperidin-4-yl)oxy]pyridazin-3-yl}pyrimidin-5-amine |
| 458[1] | 3-[2,6-difluoro-4-(1H-pyrazol-4-yl)phenyl]-6-[(2,2,6,6-tetramethylpiperidin-4-yl)oxy]pyridazine |
| 459 | 2-[6-(2,6-diazaspiro[3.4]oct-2-yl)pyridazin-3-yl]-5-(1H-pyrazol-4-yl)phenol |
| 460[1] | 3-{6-[methyl(2,2,6,6-tetramethylpiperidin-4-yl)amino]pyridazin-3-yl}-6-(1H-pyrazol-4-yl)pyridin-2-ol |
| 461 | 6-(1H-pyrazol-4-yl)-3-{6-[(2,2,6,6-tetramethylpiperidin-4-yl)oxy]pyridazin-3-yl}pyridin-2-ol |
| 462[1] | N,2,2,6,6-pentamethyl-N-{5-[3-(1H-pyrazol-4-yl)phenoxy]-1,3,4-thiadiazol-2-yl}piperidin-4-amine |
| 463[1] | N,2,2,6,6-pentamethyl-N-{5-[4-(1H-pyrazol-4-yl)phenoxy]-1,3,4-thiadiazol-2-yl}piperidin-4-amine |
| 464[1] | 3-[2-(difluoromethyl)-4-(1H-pyrazol-4-yl)phenyl]-6-[(2,2,6,6-tetramethylpiperidin-4-yl)oxy]pyridazine and |
| 465[1] | 6-[2-(difluoromethyl)-4-(1H-pyrazol-4-yl)phenyl]-N-methyl-N-(2,2,6,6-tetramethylpiperidin-4-yl)pyridazin-3-amine | wherein a form of the compound is selected from the group consisting of a prodrug, salt, hydrate, solvate, clathrate, isotopologue, racemate, enantiomer, diastereomer, stereoisomer, polymorph and tautomer form thereof.

In another aspect, the compound of Formula (I) or a form thereof used in a method disclosed herein is a compound salt selected from the group consisting of:

| Cpd | Name |
|---|---|
| 32 | 2-(6-(methyl(2,2,6,6-tetramethylpiperidin-4-yl)amino)pyridazin-3-yl)-4-(trifluoromethyl)phenol hydrochloride |
| 53 | 2-(6-(methyl(2,2,6,6-tetramethylpiperidin-4-yl)amino)pyridazin-3-yl)-4-(1H-pyrazol-1-yl)phenol hydrochloride |
| 65 | 2-(6-piperazin-1-yl-pyridazin-3-yl)-5-1H-pyrazol-1-yl-phenol hydrochloride |
| 82 | 3-(6-(piperazin-1-yl)pyridazin-3-yl)naphthalene-2,7-diol trifluoroacetate |
| 86 | 3-(6-(1,2,3,6-tetrahydropyridin-4-yl)pyridazin-3-yl)naphthalene-2,7-diol trifluoroacetate |
| 88 | 3-(6-(1-methyl-1,2,3,6-tetrahydropyridin-4-yl)pyridazin-3-yl)naphthalene-2,7-diol trifluoroacetate |
| 89 | 3-(6-(piperidin-4-yl)pyridazin-3-yl)naphthalene-2,7-diol trifluoroacetate |
| 151 | 6-hydroxy-5-(6-(methyl(2,2,6,6-tetramethylpiperidin-4-yl)amino)pyridazin-3-yl)-2,3-dihydro-1H-inden-1-one oxime hydrochloride |
| 153 | 2-amino-6-(6-(methyl(2,2,6,6-tetramethylpiperidin-4-yl)amino)pyridazin-3-y1)-8H-indeno[1,2-d]thiazol-5-ol hydrochloride |
| 154 | 9-(6-(methyl(2,2,6,6-tetramethylpiperidin-4-yl)amino)pyridazin-3-yl)-5,6-dihydroimidazo[5,1-a]isoquinolin-8-ol hydrochloride |
| 160 | 3-fluoro-5-(2-methoxypyridin-4-yl)-2-(6-(methyl(2,2,6,6-tetramethylpiperidin-4-yl)amino)pyridazin-3-yl)phenol hydrochloride |
| 161 | 4-(3-fluoro-5-hydroxy-4-(6-(methyl(2,2,6,6-tetramethylpiperidin-4-yl)amino)pyridazin-3-yl)phenyl)pyridin-2(1H)-one hydrochloride |
| 162 | 4-(3-fluoro-5-hydroxy-4-(6-(methyl(2,2,6,6-tetramethylpiperidin-4-yl)amino)pyridazin-3-yl)phenyl)-1-methylpyridin-2(1H)-one hydrochloride |
| 163 | 5-(3-fluoro-5-hydroxy-4-(6-(methyl(2,2,6,6-tetramethylpiperidin-4-yl)amino)pyridazin-3-yl)phenyl)-1-methylpyridin-2(1H)-one hydrochloride |
| 164 | 3-fluoro-5-(1H-pyrazol-4-yl)-2-(6-((2,2,6,6-tetramethylpiperidin-4-yl)oxy)pyridazin-3-yl)phenol hydrochloride |
| 165 | 5-chloro-3-fluoro-2-(6-(methyl(2,2,6,6-tetramethylpiperidin-4-yl)amino)pyridazin-3-yl)phenol hydrochloride |
| 166 | 3-fluoro-2-(6-(methyl(2,2,6,6-tetramethylpiperidin-4-yl)amino)pyridazin-3-yl)-5-(1H-pyrazol-4-yl)phenol hydrochloride |
| 167 | 3-fluoro-2-(6-(methyl(2,2,6,6-tetramethylpiperidin-4-yl)amino)pyridazin-3-yl)-5-(1- |

| Cpd | Name |
|---|---|
| | methyl-1H-pyrazol-4-yl)phenol hydrochloride |
| 226 | 3-(1H-imidazol-1-yl)-6-(6-(methyl(2,2,6,6-tetramethylpiperidin-4-yl)amino)pyridazin-3-yl)quinolin-7-ol hydrochloride |
| 227 | 6-(6-(methyl(2,2,6,6-tetramethylpiperidin-4-yl)amino)pyridazin-3-yl)quinoline-3,7-diol formate |
| 231 | 7-hydroxy-1-methyl-6-(6-(methyl(2,2,6,6-tetramethylpiperidin-4-yl)amino)pyridazin-3-yl)quinolin-2(1H)-one hydrochloride |
| 238 | 4-methoxy-7-(6-(methyl(2,2,6,6-tetramethylpiperidin-4-yl)amino)pyridazin-3-yl)quinolin-6-ol formate |
| 239 | 7-(6-(methyl(2,2,6,6-tetramethylpiperidin-4-yl)amino)pyridazin-3-yl)quinoxalin-6-ol hydrochloride |
| 254 | 2-methyl-6-(6-(methyl(2,2,6,6-tetramethylpiperidin-4-yl)amino)pyridazin-3-yl)-4-(tetrahydro-2H-pyran-4-yl)quinolin-7-ol formate |
| 256 | 4-(dimethylamino)-6-(6-(methyl(2,2,6,6-tetramethylpiperidin-4-yl)amino)pyridazin-3-yl)-quinolin-7-ol formate |
| 281 | 6-hydroxy-2-methyl-7-(6-(methyl(2,2,6,6-tetramethylpiperidin-4-yl)amino)pyridazin-3-yl)isoquinolin-1(2H)-one hydrochloride |
| 322 | 3-(5-(methyl(2,2,6,6-tetramethylpiperidin-4-yl)amino)-1,3,4-thiadiazol-2-yl)naphthalen-2-ol hydrobromide |
| 342 | N-methyl-5-(5-(1-methyl-1H-pyrazol-4-yl)pyridin-2-yl)-N-(2,2,6,6-tetramethylpiperidin-4-yl)-1,3,4-thiadiazol-2-amine hydrochloride |
| 396 | 3-fluoro-2-(5-((3aR,6aS)-hexahydropyrrolo[3,4-c]pyrrol-2(1H)-yl)-1,3,4-thiadiazol-2-yl)-5-(1H-pyrazol-4-yl)phenol dihydrochloride |
| 405 | 2-(2-chloro-4-(1H-pyrazol-4-yl)phenyl)-5-((3aR,6aS)-hexahydropyrrolo[3,4-c]pyrrol-2(1H)-yl)-1,3,4-thiadiazole hydrochloride |
| 406 | 2-(2-chloro-4-(1H-pyrazol-4-yl)phenyl)-5-(2,7-diazaspiro[4.5]decan-2-yl)-1,3,4-thiadiazole hydrochloride |
| 407 | (R)-(4-(5-(2-chloro-4-(1H-pyrazol-4-yl)phenyl)-1,3,4-thiadiazol-2-yl)piperazin-2-yl)methanol hydrochloride |
| 411 | 2-{6-[8-azabicyclo[3.2.1]oct-3-yl(methyl)amino]pyridazin-3-yl}-5-(1H-pyrazol-4-yl)phenol hydrochloride |
| 412 | 2-[6-(8-azabicyclo[3.2.1]oct-3-ylamino)pyridazin-3-yl]-5-(1H-pyrazol-4-yl)phenol hydrochloride |
| 413 | 5-(1H-pyrazol-4-yl)-2-{6-[(2,2,6,6-tetramethylpiperidin-4-yl)amino]pyridazin-3-yl}phenol hydrochloride |
| 415 | 2-[6-(8-azabicyclo[3.2.1]oct-3-yloxy)pyridazin-3-yl]-5-(1H-pyrazol-4-yl)phenol hydrochloride |
| 419 | 2-(6-[methyl(2,2,6,6-tetramethylpiperidin-4-yl)amino]pyridazin-3-yl}-5-(4-nitro-1H-pyrazol-1-yl)phenol dihydrochloride |
| 422 | 2-[6-(1-methyl-1,2,3,6-tetrahydropyridin-4-yl)pyridazin-3-yl]-5-(1H-pyrazol-4-yl)phenol trihydrochloride |
| 424 | 5-(1H-pyrazol-4-yl)-2-[6-(1,2,3,6-tetrahydropyridin-4-yl)pyridazin-3-yl]phenol trihydrochloride |
| 425 | 2-[6-(1-ethyl-1,2,3,6-tetrahydropyridin-4-yl)pyridazin-3-yl]-5-(1H-pyrazol-4-yl)phenol trihydrochloride |
| 426 | 2-{6-[methyl(piperidin-4-yl)amino]pyridazin-3-yl}-5-(1H-pyrazol-4-yl)phenol tetrahydrochloride |
| 427 | 2-[6-(piperidin-4-ylamino)pyridazin-3-yl]-5-(1H-pyrazol-4-yl)phenol tetrahydrochloride |
| 428 | 6-[2,5-difluoro-4-(1H-pyrazol-4-yl)phenyl]-N-methyl-N-(2,2,6,6-tetramethylpiperidin-4-yl)pyridazin-3-amine tetrahydrochloride |
| 429 | 2-[6-(8-azabicyclo[3.2.1]oct-2-en-3-yl)pyridazin-3-yl]-5-(1H-pyrazol-4-yl)phenol hydrochloride |
| 430 | 6-[2,3-difluoro-4-(1H-pyrazol-4-yl)phenyl]-N-methyl-N-(2,2,6,6-tetramethylpiperidin-4-yl)pyridazin-3-amine hydrochloride |
| 431 | 3-[2,5-difluoro-4-(1H-pyrazol-4-yl)phenyl]-6-[(2,2,6,6-tetramethylpiperidin-4-yl)oxy]pyridazine trihydrochloride |
| 433 | 2-{6-[(1R,5S)-8-azabicyclo[3.2.1]oct-3-ylamino]pyridazin-3-yl}-5-(1H-pyrazol-4-yl)phenol hydrochloride |
| 434 | 6-[2-methoxy-6-(1H-pyrazol-4-yl)pyridin-3-yl]-N-methyl-N-(2,2,6,6-tetramethylpiperidin-4-yl)pyridazin-3-amine hydrochloride |
| 436 | 2-{6-[(2,6-dimethylpiperidin-4-yl)oxy]pyridazin-3-yl}-5-(1H-pyrazol-4-yl)phenol trihydrochloride |
| 437 | 3-[2-fluoro-4-(1H-pyrazol-4-yl)phenyl]-6-[(2,2,6,6-tetramethylpiperidin-4-yl)oxy]pyridazine hydrochloride |
| 439 | 2-[6-(2,7-diazaspiro[3.5]non-2-yl)pyridazin-3-yl]-5-(1H-pyrazol-4-yl)phenol tetrahydrochloride |
| 448 | 3-[5-(1H-pyrazol-4-yl)thiophen-2-yl]-6-[(2,2,6,6-tetramethylpiperidin-4-yl)oxy]pyridazine hydrochloride |
| 450 | 3-[4-(1H-pyrazol-4-yl)thiophen-2-yl]-6-[(2,2,6,6-tetramethylpiperidin-4-yl)oxy]pyridazine hydrochloride |
| 456 | 6-[2-chloro-4-(1H-pyrazol-4-yl)phenyl]-N-methyl-N-(2,2,6,6-tetramethylpiperidin-4-yl)pyridazin-3-amine trihydrochloride |
| 458 | 3-[2,6-difluoro-4-(1H-pyrazol-4-yl)phenyl]-6-[(2,2,6,6-tetramethylpiperidin-4-yl)oxy]pyridazine trihydrochloride |
| 460 | 3-{6-[methyl(2,2,6,6-tetramethylpiperidin-4-yl)amino]pyridazin-3-yl}-6-(1H-pyrazol-4-yl)pyridin-2-ol hydrochloride |
| 462 | N,2,2,6,6-pentamethyl-N-{5-[3-(1H-pyrazol-4-yl)phenoxy]-1,3,4-thiadiazol-2- |

| Cpd | Name |
|---|---|
| | yl}piperidin-4-amine hydrochloride |
| 463 | N,2,2,6,6-pentamethyl-N-{5-[4-(1H-pyrazol-4-yl)phenoxy]-1,3,4-thiadiazol-2-yl}piperidin-4-amine hydrochloride |
| 464 | 3-[2-(difluoromethyl)-4-(1H-pyrazol-4-yl)phenyl]-6-[(2,2,6,6-tetramethylpiperidin-4-yl)oxy]pyridazine hydrochloride and |
| 465 | 6-[2-(difluoromethyl)-4-(1H-pyrazol-4-yl)phenyl]-N-methyl-N-(2,2,6,6-tetramethylpiperidin-4-yl)pyridazin-3-amine hydrochloride | wherein a form of the compound salt is selected from the group consisting of a prodrug, hydrate, solvate, clathrate, isotopologue, racemate, enantiomer, diastereomer, stereoisomer, polymorph and tautomer form thereof.

In another aspect, the compound of Formula (I) used in a method disclosed herein is a compound salt selected from the group consisting of:

| Cp | Name |
|---|---|
| 411 | 2-{6-[8-azabicyclo[3.2.1]oct-3-yl(methyl)amino]pyridazin-3-yl}-5-(1H-pyrazol-4-yl)phenol hydrochloride |
| 412 | 2-[6-(8-azabicyclo[3.2.1]oct-3-ylamino)pyridazin-3-yl]-5-(1H-pyrazol-4-yl)phenol hydrochloride |
| 413 | 5-(1H-pyrazol-4-yl)-2-{6-[(2,2,6,6-tetramethylpiperidin-4-yl)amino]pyridazin-3-yl}phenol hydrochloride |
| 415 | 2-[6-(8-azabicyclo[3.2.1]oct-3-yloxy)pyridazin-3-yl]-5-(1H-pyrazol-4-yl)phenol hydrochloride |
| 419 | 2-{6-[methyl(2,2,6,6-tetramethylpiperidin-4-yl)amino]pyridazin-3-yl}-5-(4-nitro-1H-pyrazol-1-yl)phenol dihydrochloride |
| 422 | 2-[6-(1-methyl-1,2,3,6-tetrahydropyridin-4-yl)pyridazin-3-yl]-5-(1H-pyrazol-4-yl)phenol trihydrochloride |
| 424 | 5-(1H-pyrazol-4-yl)-2-[6-(1,2,3,6-tetrahydropyridin-4-yl)pyridazin-3-yl]phenol trihydrochloride |
| 425 | 2-[6-(1-ethyl-1,2,3,6-tetrahydropyridin-4-yl)pyridazin-3-yl]-5-(1H-pyrazol-4-yl)phenol trihydrochloride |
| 426 | 2-{6-[methyl(piperidin-4-yl)amino]pyridazin-3-yl}-5-(1H-pyrazol-4-yl)phenol tetrahydrochloride |
| 427 | 2-[6-(piperidin-4-ylamino)pyridazin-3-yl]-5-(1H-pyrazol-4-yl)phenol tetrahydrochloride |
| 428 | 6-[2,5-difluoro-4-(1H-pyrazol-4-yl)phenyl]-N-methyl-N-(2,2,6,6-tetramethylpiperidin-4-yl)pyridazin-3-amine tetrahydrochloride |
| 429 | 2-[6-(8-azabicyclo[3.2.1]oct-2-en-3-yl)pyridazin-3-yl]-5-(1H-pyrazol-4-yl)phenol hydrochloride |
| 430 | 6-[2,3-difluoro-4-(1H-pyrazol-4-yl)phenyl]-N-methyl-N-(2,2,6,6-tetramethylpiperidin-4-yl)pyridazin-3-amine hydrochloride |
| 431 | 3-[2,5-difluoro-4-(1H-pyrazol-4-yl)phenyl]-6-[(2,2,6,6-tetramethylpiperidin-4-yl)oxy]pyridazine trihydrochloride |
| 433 | 2-{6-[(1R,5S)-8-azabicyclo[3.2.1]oct-3-ylamino]pyridazin-3-yl}-5-(1H-pyrazol-4-yl)phenol hydrochloride |
| 434 | 6-[2-methoxy-6-(1H-pyrazol-4-yl)pyridin-3-yl]-N-methyl-N-(2,2,6,6-tetramethylpiperidin-4-yl)pyridazin-3-amine hydrochloride |
| 436 | 2-{6-[(2,6-dimethylpiperidin-4-yl)oxy]pyridazin-3-yl}-5-(1H-pyrazol-4-yl)phenol trihydrochloride |
| 437 | 3-[2-fluoro-4-(1H-pyrazol-4-yl)phenyl]-6-[(2,2,6,6-tetramethylpiperidin-4-yl)oxy]pyridazine hydrochloride |
| 439 | 2-[6-(2,7-diazaspiro[3.5]non-2-yl)pyridazin-3-yl]-5-(1H-pyrazol-4-yl)phenol tetrahydrochloride |
| 448 | 3-[5-(1H-pyrazol-4-yl)thiophen-2-yl]-6-[(2,2,6,6-tetramethylpiperidin-4-yl)oxy]pyridazine hydrochloride |
| 450 | 3-[4-(1H-pyrazol-4-yl)thiophen-2-yl]-6-[(2,2,6,6-tetramethylpiperidin-4-yl)oxy]pyridazine hydrochloride |
| 456 | 6-[2-chloro-4-(1H-pyrazol-4-yl)phenyl]-N-methyl-N-(2,2,6,6-tetramethylpiperidin-4-yl)pyridazin-3-amine trihydrochloride |
| 458 | 3-[2,6-difluoro-4-(1H-pyrazol-4-yl)phenyl]-6-[(2,2,6,6-tetramethylpiperidin-4-yl)oxy]pyridazine trihydrochloride |
| 460 | 3-{6-[methyl(2,2,6,6-tetramethylpiperidin-4-yl)amino]pyridazin-3-yl}-6-(1H-pyrazol-4-yl)pyridin-2-ol hydrochloride |
| 462 | N,2,2,6,6-pentamethyl-N-{5-[3-(1H-pyrazol-4-yl)phenoxy]-1,3,4-thiadiazol-2-yl}piperidin-4-amine hydrochloride |
| 463 | N,2,2,6,6-pentamethyl-N-{5-[4-(1H-pyrazol-4-yl)phenoxy]-1,3,4-thiadiazol-2-yl}piperidin-4-amine hydrochloride |
| 464 | 3-[2-(difluoromethyl)-4-(1H-pyrazol-4-yl)phenyl]-6-[(2,2,6,6-tetramethylpiperidin-4-yl)oxy]pyridazine hydrochloride and |
| 465 | 6-[2-(difluoromethyl)-4-(1H-pyrazol-4-yl)phenyl]-N-methyl-N-(2,2,6,6-tetramethylpiperidin-4-yl)pyridazin-3-amine hydrochloride | wherein a form of the compound salt is selected from the group consisting of a prodrug, hydrate, solvate, clathrate, isotopologue, racemate, enantiomer, diastereomer, stereoisomer, polymorph and tautomer form thereof.

Terminology

As used herein, the term "$C_{1-4}$alkyl" generally refers to saturated hydrocarbon radicals having from one to four carbon atoms in a straight or branched chain configuration, including, without limitation, methyl, ethyl, n-propyl, isopropyl, n-butyl, isobutyl, sec-butyl, tert-butyl, and the like. In some aspects, $C_{1-4}$alkyl includes $C_{1-3}$alkyl, $C_{1-2}$alkyl, and the like. A $C_{1-4}$alkyl radical may be optionally substituted where allowed by available valences.

As used herein, the term "$C_{2-6}$alkenyl" generally refers to partially unsaturated hydrocarbon radicals having from two to five carbon atoms in a straight or branched chain configuration and one or more carbon-carbon double bonds therein, including, without limitation, ethenyl, allyl, propenyl and the like. In some aspects, $C_{2-6}$alkenyl includes $C_{2-4}$alkenyl, $C_{2-3}$alkenyl, and the like. A $C_{2-6}$alkenyl radical may be optionally substituted where allowed by available valences.

As used herein, the term "$C_{1-4}$alkoxy" generally refers to saturated hydrocarbon radicals having from one to four carbon atoms in a straight or branched chain configuration of the formula: —O—$C_{1-4}$alkyl, including, without limitation, methoxy, ethoxy, n-propoxy, isopropoxy, n-butoxy, isobutoxy, sec-butoxy, tert-butoxy, and the like. In some aspects, $C_{1-4}$alkoxy includes $C_{1-3}$alkoxy, $C_{1-2}$alkoxy and the like. A $C_{1-4}$alkoxy radical may be optionally substituted where allowed by available valences.

As used herein, the term "$C_{3-14}$cycloalkyl" generally refers to a saturated monocyclic, bicyclic or polycyclic hydrocarbon radical, including, without limitation, cyclopropyl, cyclobutyl, cyclopentyl, cyclohexyl, cycloheptyl, cyclooctyl, 1H-indanyl, indenyl, tetrahydro-naphthalenyl and the like. In some aspects, $C_{3-4}$cycloalkyl includes $C_{3-10}$cycloalkyl, $C_{3-8}$cycloalkyl, $C_{3-7}$cycloalkyl, $C_{5-8}$cycloalkyl, $C_{9-10}$cycloalkyl and the like. A $C_{3-14}$cycloalkyl radical may be optionally substituted where allowed by available valences.

As used herein, the term "$C_{3-14}$cycloalkenyl" generally refers to a partially unsaturated monocyclic, bicyclic or polycyclic hydrocarbon radical having one or more chemically stable carbon-carbon double bonds therein, including, without limitation, cyclopropenyl, cyclobutenyl, cyclopentenyl, cyclohexenyl, cycloheptenyl, cyclooctenyl and the like. In some aspects, $C_{3-14}$cycloalkenyl includes $C_{3-7}$cycloalkenyl, $C_{3-8}$cycloalkenyl, $C_{5-8}$cycloalkenyl, $C_{3-10}$cycloalkenyl and the like. A $C_{3-14}$cycloalkenyl radical may be optionally substituted where allowed by available valences.

As used herein, the term "aryl" generally refers to a monocyclic, bicyclic or polycyclic aromatic carbon atom ring structure radical, including, without limitation, phenyl, naphthyl, anthracenyl, fluorenyl, azulenyl, phenanthrenyl and the like. An aryl radical may be optionally substituted where allowed by available valences.

As used herein, the term "heteroaryl" generally refers to a monocyclic, bicyclic or polycyclic aromatic carbon atom ring structure radical in which one or more carbon atom ring members have been replaced, where allowed by structural stability, with one or more heteroatoms, such as an O, S or N atom, including, without limitation, furanyl, thienyl (also referred to as thiophenyl), pyrrolyl, pyrazolyl, imidazolyl, isoxazolyl, isothiazolyl, oxazolyl, thiazolyl, triazolyl, oxadiazolyl, thiadiazolyl, tetrazolyl, pyranyl, thiopyranyl, pyridinyl, pyrimidinyl, pyrazinyl, pyridazinyl, triazinyl, indolyl, indazolyl, indolizinyl, benzofuranyl, benzothienyl, benzimidazolyl, benzothiazolyl, benzooxazolyl, 9H-purinyl, quinoxalinyl, isoindolyl, quinolinyl, isoquinolinyl, quinazolinyl, acridinyl, phthalazinyl, imidazo[1,2-a]pyridinyl, imidazo[1,5-a]pyridinyl, imidazo[5,1-a]isoquinolinyl, 1,4-dihydroindeno[1,2-c]-1H-pyrazolyl, 2,3-dihydro-1H-inden-1-one, 2,3-dihydro-1H-indenyl, 3,4-dihydroquinolin-2(H)-one, 5,6-dihydroimidazo[5,1-a]isoquinolinyl, 8H-indeno[1,2-d]thiazolyl, benzo[c][1,2,5]oxadiazolyl, benzo[d]oxazol-2(3H)-one, quinolin-2(1H)-one, quinazolin-4(1H)-one, quinazoline-2,4(1H,3H)-dione, benzo-[d]oxazolyl, pyrazolo[1,5-a]pyridinyl, and the like. A heteroaryl radical may be optionally substituted on a carbon or nitrogen atom ring member where allowed by available valences.

As used herein, the term "heterocyclyl" generally refers to a saturated or partially unsaturated monocyclic, bicyclic or polycyclic carbon atom ring structure radical in which one or more carbon atom ring members have been replaced, where allowed by structural stability, with a heteroatom, such as an O, S or N atom, including, without limitation, oxiranyl, oxetanyl, azetidinyl, dihydrofuranyl, tetrahydrofuranyl, dihydrothienyl, tetrahydrothienyl, pyrrolinyl, pyrrolidinyl, dihydropyrazolyl, pyrazolinyl, pyrazolidinyl, dihydroimidazolyl, imidazolinyl, imidazolidinyl, isoxazolinyl, isoxazolidinyl, isothiazolinyl, isothiazolidinyl, oxazolinyl, oxazolidinyl, thiazolinyl, thiazolidinyl, triazolinyl, triazolidinyl, oxadiazolinyl, oxadiazolidinyl, thiadiazolinyl, thiadiazolidinyl, tetrazolinyl, tetrazolidinyl, dihydro-2H-pyranyl, dihydro-pyridinyl, tetrahydro-pyridinyl, 1,2,3,6-tetrahydropyridinyl, hexahydro-pyridinyl, dihydro-pyrimidinyl, tetrahydro-pyrimidinyl, 1,4,5,6-tetrahydropyrimidinyl, dihydro-pyrazinyl, tetrahydro-pyrazinyl, dihydro-pyridazinyl, tetrahydro-pyridazinyl, piperazinyl, piperidinyl, morpholinyl, thiomorpholinyl, dihydro-triazinyl, tetrahydro-triazinyl, hexahydro-triazinyl, 1,4-diazepanyl, dihydro-indolyl, indolinyl, tetrahydro-indolyl, dihydro-indazolyl, tetrahydro-indazolyl, dihydro-isoindolyl, dihydro-benzofuranyl, tetrahydro-benzofuranyl, dihydro-benzothienyl, tetrahydro-benzothienyl, dihydro-benzimidazolyl, tetrahydro-benzimidazolyl, dihydro-benzooxazolyl, 2,3-dihydrobenzo[d]oxazolyl, tetrahydro-benzooxazolyl, dihydro-benzooxazinyl, 3,4-dihydro-2H-benzo[b][1,4]oxazinyl, tetrahydro-benzooxazinyl, benzo[1,3]dioxolyl, benzo[1,4]dioxanyl, dihydro-purinyl, tetrahydro-purinyl, dihydro-quinolinyl, tetrahydro-quinolinyl, 1,2,3,4-tetrahydroquinolinyl, dihydro-isoquinolinyl, 3,4-dihydroisoquinolin-(1H)-yl, tetrahydro-isoquinolinyl, 1,2,3,4-tetrahydroisoquinolinyl, dihydro-quinazolinyl, tetrahydro-quinazolinyl, dihydro-quinoxalinyl, tetrahydro-quinoxalinyl, 1,2,3,4-tetrahydroquinoxalinyl, 1,3-dioxolanyl, 2,5-dihydro-1H-pyrrolyl, 4,5-dihydro-1H-imidazolyl, tetrahydro-2H-pyranyl, hexahydropyrrolo[3,4-b][1,4]oxazin-(2H)-yl, (4aR,7aS)-hexahydropyrrolo[3,4-b][1,4]oxazin-(4aH)-yl, 3,4-dihydro-2H-pyrido[3,2-b][1,4]oxazinyl, (cis)-octahydrocyclopenta[c]pyrrolyl, hexahydropyrrolo[3,4-b]pyrrol-(1H)-yl, (3aR,6aR)-hexahydropyrrolo[3,4-b]pyrrol-(1H)-yl, (3aR,6aS)-hexahydropyrrolo[3,4-c]pyrrol-(1H)-yl, 5H-pyrrolo[3,4-b]pyridin-(7H)-yl, 5,7-dihydro-6H-pyrrolo[3,4-b]pyridinyl, tetrahydro-1H-pyrrolo[3,4-b]pyridin-(2H,7H,7aH)-yl, hexahydro-1H-pyrrolo[3,4-b]pyridin-(2H)-yl, (4aR,7aR)-hexahydro-1H-pyrrolo[3,4-b]pyridin-(2H)-yl, octahydro-6H-pyrrolo[3,4-b]pyridinyl, 2,3,4,9-tetrahydro-1H-carbazolyl, 1,2,3,4-tetrahydropyrazino[1,2-a]indolyl, 2,3-dihydro-1H-pyrrolo[1,2-a]indolyl, (3aR,6aR)-hexahydrocyclopenta[c]pyrrol- (1H)-yl, (3aR,4R,6aS)-hexahydrocyclopenta[c]pyrrol-(1H)-yl, (3aR,4S,6aS)-hexahydrocyclopenta[c]pyrrol-(1H)-yl, (3aR,5r,6aS)-hexahydrocyclopenta[c]pyrrol-(1H)-yl, 1,3-dihydro-2H-isoindolyl, octahydro-2H-isoindolyl, (3aS)-1,3,3a,4,5,6-hexahydro-2H-isoindolyl, (3aR,4R,7aS)-1H-isoindol-(3H,3aH,4H,5H,6H,7H,7aH)-yl, (3aR,7aS)-octahydro-2H-isoindolyl, (3aR,4R,7aS)-octahydro-2H-isoindolyl, (3aR,4S,7aS)-octahydro-2H-isoindolyl, 2,5-diazabicyclo[2.2.1]heptanyl, 2-azabicyclo[2.2.1]heptenyl, 3-azabicyclo[3.1.0]hexanyl, 3,6-diazabicyclo[3.1.0]hexanyl, (1R,5S)-3-azabicyclo[3.1.0]hexanyl, (1S,5R)-3-azabicyclo[3.2.0]heptanyl, 5-azaspiro[2.4]heptanyl, 2,6-diazaspiro[3.3]heptanyl, 2,5-diazaspiro[3.4]octanyl, 2,6-diazaspiro[3.4]octanyl, 2,7-diazaspiro[3.5]nonanyl, 2,7-diazaspiro[4.4]nonanyl, 2-azaspiro[4.5]decanyl, 2,8-diazaspiro[4.5]decanyl, 3,6-diazabicyclo[3.2.1]octyl, 1,4-dihydroindeno[1,2-c]pyrazolyl, dihydropyranyl, dihydropyridinyl, dihydroquinolinyl, 8H-indeno[1,2-d]thiazolyl, tetrahydroimidazo[1,2-a]pyridinyl, pyridin-2(1H)-one, (1R,5S)-8-azabicyclo[3.2.1]octyl, 8-azabicyclo[3.2.1]oct-2-enyl and the like. A heterocyclyl radical may be optionally substituted on a carbon or nitrogen atom ring member where allowed by available valences.

As used herein, the term "$C_{2-4}$alkenyl-amino-carbonyl" refers to a radical of the formula: —C(=O)—NH—$C_{2-4}$alkenyl.

As used herein, the term "$C_{1-4}$alkoxy-$C_{1-4}$alkoxy" refers to a radical of the formula: —O—$C_{1-4}$alkyl-O—$C_{1-4}$alkyl.

As used herein, the term "$C_{1-4}$alkoxy-carbonyl" refers to a radical of the formula: —C(=O)—O—$C_{1-4}$alkyl.

As used herein, the term "$C_{1-4}$alkoxy-carbonyl-amino" refers to a radical of the formula: —NH—C(=O)—O—$C_{1-4}$alkyl.

As used herein, the term "$C_{1-4}$alkoxy-carbonyl-amino-$C_{1-4}$alkoxy" refers to a radical of the formula: —O—$C_{1-4}$alkyl-NH—C(=O)—O—$C_{1-4}$alkyl.

As used herein, the term "$C_{1-4}$alkyl-$C_{1-4}$alkoxy" refers to a radical of the formula: —O—$C_{1-4}$alkyl-$C_{1-4}$alkyl.

As used herein, the term "$C_{1-4}$alkyl-amino" refers to a radical of the formula: —NH—$C_{1-4}$alkyl.

As used herein, the term "$(C_{1-4}$alkyl$)_2$-amino" refers to a radical of the formula: —N($C_{1-4}$alkyl$)_2$.

As used herein, the term "$C_{1-4}$alkyl-amino-$C_{1-4}$alkoxy" refers to a radical of the formula: —O—$C_{1-4}$alkyl-NH—$C_{1-4}$alkyl.

As used herein, the term "$(C_{1-4}$alkyl$)_2$-amino-$C_{1-4}$alkoxy" refers to a radical of the formula: —O—$C_{1-4}$alkyl-N($C_{1-4}$alkyl$)_2$.

As used herein, the term "$C_{1-4}$alkyl-amino-$C_{1-4}$alkyl" refers to a radical of the formula: —$C_{1-4}$alkyl-NH—$C_{1-4}$alkyl.

As used herein, the term "$(C_{1-4}$alkyl$)_2$-amino-$C_{1-4}$alkyl" refers to a radical of the formula: —$C_{1-4}$alkyl-N($C_{1-4}$alkyl$)_2$.

As used herein, the term "$C_{1-4}$alkyl-amino-carbonyl" refers to a radical of the formula: —C(=O)—NH—$C_{1-4}$alkyl.

As used herein, the term "$(C_{1-4}$alkyl$)_2$-amino-carbonyl" refers to a radical of the formula: —C(=O)—N($C_{1-4}$alkyl$)_2$.

As used herein, the term "$C_{1-4}$alkyl-amino-carbonyl-$C_{1-4}$alkyl" refers to a radical of the formula: —$C_{1-4}$alkyl-C(=O)—NH—$C_{1-4}$alkyl.

As used herein, the term "$(C_{1-4}$alkyl$)_2$-amino-carbonyl-$C_{1-4}$alkyl" refers to a radical of the formula: —$C_{1-4}$alkyl-C(=O)—N($C_{1-4}$alkyl$)_2$.

As used herein, the term "$C_{1-4}$alkyl-carbonyl" refers to a radical of the formula: —C(=O)—$C_{1-4}$alkyl.

As used herein, the term "$C_{1-4}$alkyl-carbonyl-amino" refers to a radical of the formula: —NH—C(=O)—$C_{1-4}$alkyl.

As used herein, the term "$C_{1-4}$alkyl-carbonyl-amino-$C_{1-4}$alkoxy" refers to a radical of the formula: —O—$C_{1-4}$alkyl-NH—C(=O)—$C_{1-4}$alkyl.

As used herein, the term "$C_{1-4}$alkyl-carbonyl-amino-$C_{1-4}$alkyl" refers to a radical of the formula: —$C_{1-4}$alkyl-NH—C(=O)—$C_{1-4}$alkyl.

As used herein, the term "amino" refers to a radical of the formula: —$NH_2$.

As used herein, the term "amino-$C_{1-4}$alkoxy" refers to a radical of the formula: —O—$C_{1-4}$alkyl-$NH_2$.

As used herein, the term "amino-$C_{1-4}$alkyl" refers to a radical of the formula: —$C_{1-4}$alkyl-$NH_2$.

As used herein, the term "amino-carbonyl" refers to a radical of the formula: —C(=O)—$NH_2$.

As used herein, the term "cyano" refers to a radical of the formula: —CN.

As used herein, the term "$C_{3-7}$cycloalkyl-$C_{1-4}$alkoxy" refers to a radical of the formula: —O—$C_{1-4}$alkyl-$C_{3-7}$cycloalkyl.

As used herein, the term "halo-$C_{1-4}$alkoxy" refers to a radical of the formula: —O—$C_{1-4}$alkyl-halo, wherein $C_{1-4}$alkyl may be partially or completely substituted where allowed by available valences with one or more halogen atoms. In some aspects, halo-$C_{1-4}$alkoxy includes halo-$C_{1-6}$alkoxy, halo-$C_{1-4}$alkoxy and the like.

As used herein, the term "halo-$C_{1-4}$alkyl" refers to a radical of the formula: —$C_{1-4}$alkyl-halo, wherein $C_{1-4}$alkyl may be partially or completely substituted where allowed by available valences with one or more halogen atoms. In some aspects, halo-$C_{1-4}$alkyl includes halo-$C_{1-4}$alkyl, halo-$C_{1-4}$alkyl and the like.

As used herein, the term "heteroaryl-$C_{1-4}$alkyl" refers to a radical of the formula: —$C_{1-4}$alkyl-heteroaryl.

As used herein, the term "heteroaryl-$C_{1-4}$alkyl-amino" refers to a radical of the formula: —NH—$C_{1-4}$alkyl-heteroaryl.

As used herein, the term "heteroaryl-$C_{1-4}$alkyl-amino-carbonyl" refers to a radical of the formula: —C(=O)—NH—$C_{1-4}$alkyl-heteroaryl.

As used herein, the term "heteroaryl-$C_{1-4}$alkyl-amino-carbonyl-$C_{1-4}$alkyl" refers to a radical of the formula: —$C_{1-4}$alkyl-C(=O)—NH—$C_{1-4}$alkyl-heteroaryl.

As used herein, the term "heteroaryl-$C_{1-4}$alkyl-carbonyl-amino" refers to a radical of the formula: —NH—C(=O)—$C_{1-4}$alkyl-heteroaryl.

As used herein, the term "heteroaryl-$C_{1-4}$alkyl-carbonyl-amino-$C_{1-4}$alkyl" refers to a radical of the formula: —$C_{1-4}$alkyl-NH—C(=O)—$C_{1-4}$alkyl-heteroaryl.

As used herein, the term "heterocyclyl-$C_{1-4}$alkoxy" refers to a radical of the formula: —$C_{1-4}$alkoxy-heterocyclyl.

As used herein, the term "heterocyclyl-$C_{1-4}$alkyl" refers to a radical of the formula: —$C_{1-4}$alkyl-heterocyclyl.

As used herein, the term "hydroxyl" refers to a radical of the formula: —OH.

As used herein, the term "hydroxyl-$C_{1-4}$alkoxy" refers to a radical of the formula: —O—$C_{1-4}$alkyl-OH, wherein $C_{1-4}$alkyl may be partially or completely substituted where allowed by available valences with one or more hydroxy radicals.

As used herein, the term "hydroxyl-$C_{1-4}$alkyl" refers to a radical of the formula: —$C_{1-4}$alkyl-OH, wherein $C_{1-4}$alkyl may be partially or completely substituted where allowed by available valences with one or more hydroxy radicals.

As used herein, the term "hydroxyl-$C_{1-4}$alkyl-amino" refers to a radical of the formula: —NH—$C_{1-4}$alkyl-OH, wherein $C_{1-4}$alkyl may be partially or completely substituted where allowed by available valences with one or more hydroxyl radicals.

As used herein, the term "hydroxyl-imino" refers to the =NOH radical of the formula: C(=NOH).

As used herein, the term "oxo" refers to the radical of the formula: C=O.

As used herein, the term "phenyl-$C_{1-4}$alkoxy" refers to a radical of the formula: —$C_{1-4}$alkoxy-phenyl.

As used herein, the term "substituent" means positional variables on the atoms of a core molecule that are substituted at a designated atom position, replacing one or more hydrogens on the designated atom, provided that the designated atom's normal valency is not exceeded, and that the substitution results in a stable compound. Combinations of substituents and/or variables are permissible only if such combinations result in stable compounds. A person of ordinary skill in the art should note that any carbon as well as heteroatom with valences that appear to be unsatisfied as described or shown herein is assumed to have a sufficient number of hydrogen atom(s) to satisfy the valences described or shown. In certain instances one or more substituents having a double bond (e.g., "oxo" or "=O") as the point of attachment may be described, shown or listed herein within a substituent group, wherein the structure may only show a single bond as the point of attachment to the core structure of Formula (I). A person of ordinary skill in the art would understand that, while only a single bond is shown, a double bond is intended for those substituents.

As used herein, the term "and the like," with reference to the definitions of chemical terms provided herein, means that variations in chemical structures that could be expected by one skilled in the art include, without limitation, isomers (including chain, branching or positional structural isomers), hydration of ring systems (including saturation or partial unsaturation of monocyclic, bicyclic or polycyclic ring structures) and all other variations where allowed by available valences which result in a stable compound.

For the purposes of this description, where one or more substituent variables for a compound of Formula (I) or a form thereof encompass functionalities incorporated into a compound of Formula (I), each functionality appearing at any location within the disclosed compound may be independently selected, and as appropriate, independently and/or optionally substituted.

As used herein, the terms "independently selected," or "each selected" refer to functional variables in a substituent list that may occur more than once on the structure of Formula (I), the pattern of substitution at each occurrence is independent of the pattern at any other occurrence. Further, the use of a generic substituent variable on any formula or structure for a compound described herein is understood to include the replacement of the generic substituent with species substituents that are included within the particular genus, e.g., aryl may be replaced with phenyl or naphthalenyl and the like, and that the resulting compound is to be included within the scope of the compounds described herein.

As used herein, the terms "each instance of" or "in each instance, when present," when used preceding a phrase such as " . . . $C_{3-14}$cycloalkyl, $C_{3-14}$cycloalkyl-$C_{1-4}$alkyl, aryl, aryl-$C_{1-4}$alkyl, heteroaryl, heteroaryl-$C_{1-4}$alkyl, heterocyclyl and heterocyclyl-$C_{1-4}$alkyl," are intended to refer to the $C_{3-14}$cycloalkyl, aryl, heteroaryl and heterocyclyl ring systems when each are present either alone or as a substituent.

As used herein, the term "optionally substituted" means optional substitution with the specified substituent variables, groups, radicals or moieties.

Compound Forms

As used herein, the term "form" means a compound of Formula (I) having a form selected from the group consisting of a free acid, free base, prodrug, salt, hydrate, solvate, clathrate, isotopologue, racemate, enantiomer, diastereomer, stereoisomer, polymorph and tautomer form thereof.

In certain aspects described herein, the form of the compound of Formula (I) is a free acid, free base or salt thereof.

In certain aspects described herein, the form of the compound of Formula (I) is a salt thereof.

In certain aspects described herein, the form of the compound of Formula (I) is an isotopologue thereof.

In certain aspects described herein, the form of the compound of Formula (I) is a stereoisomer, racemate, enantiomer or diastereomer thereof.

In certain aspects described herein, the form of the compound of Formula (I) is a tautomer thereof.

In certain aspects described herein, the form of the compound of Formula (I) is a pharmaceutically acceptable form.

In certain aspects described herein, the compound of Formula (I) or a form thereof is isolated for use.

As used herein, the term "isolated" means the physical state of a compound of Formula (I) or a form thereof after being isolated and/or purified from a synthetic process (e.g., from a reaction mixture) or natural source or combination thereof according to an isolation or purification process or processes described herein or which are well known to the skilled artisan (e.g., chromatography, recrystallization and the like) in sufficient purity to be characterized by standard analytical techniques described herein or well known to the skilled artisan.

As used herein, the term "protected" means that a functional group in a compound of Formula (I) or a form thereof is in a form modified to preclude undesired side reactions at the protected site when the compound is subjected to a reaction. Suitable protecting groups will be recognized by those with ordinary skill in the art as well as by reference to standard textbooks such as, for example, T. W. Greene et al, *Protective Groups in organic Synthesis* (1991), Wiley, New York. Such functional groups include hydroxy, phenol, amino and carboxylic acid. Suitable protecting groups for hydroxy or phenol include trialkylsilyl or diarylalkylsilyl (e.g., t-butyldimethylsilyl, t-butyldiphenylsilyl or trimethylsilyl), tetrahydropyranyl, benzyl, substituted benzyl, methyl, methoxymethanol, and the like. Suitable protecting groups for amino, amidino and guanidino include t-butoxycarbonyl, benzyloxycarbonyl, and the like. Suitable protecting groups for carboxylic acid include alkyl, aryl or arylalkyl esters. In certain instances, the protecting group may also be a polymer resin, such as a Wang resin or a 2-chlorotrityl-chloride resin. Protecting groups may be added or removed in accordance with standard techniques, which are well-known to those skilled in the art and as described herein. It will also be appreciated by those skilled in the art, although such protected derivatives of compounds described herein may not possess pharmacological activity as such, they may be administered to a subject and thereafter metabolized in the body to form compounds described herein which are pharmacologically active. Such derivatives may therefore be described as "prodrugs". All prodrugs of compounds described herein are included within the scope of the use described herein.

As used herein, the term "prodrug" means a form of an instant compound (e.g., a drug precursor) that is transformed in vivo to yield an active compound of Formula (I) or a form thereof. The transformation may occur by various mechanisms (e.g., by metabolic and/or non-metabolic chemical processes), such as, for example, by hydrolysis and/or metabolism in blood, liver and/or other organs and tissues. A discussion of the use of prodrugs is provided by T. Higuchi and W. Stella, "Pro-drugs as Novel Delivery Systems," Vol. 14 of the A.C.S. Symposium Series, and in Bioreversible Carriers in Drug Design, ed. Edward B. Roche, American Pharmaceutical Association and Pergamon Press, 1987.

In one example, when a compound of Formula (I) or a form thereof contains a carboxylic acid functional group, a prodrug can comprise an ester formed by the replacement of the hydrogen atom of the acid group with a functional group such as alkyl and the like. In another example, when a compound of Formula (I) or a form thereof contains a hydroxyl functional group, a prodrug form can be prepared by replacing the hydrogen atom of the hydroxyl with another functional group such as alkyl, alkylcarbonyl or a phosphonate ester and the like. In another example, when a compound of Formula (I) or a form thereof contains an amine functional group, a prodrug form can be prepared by replacing one or more amine hydrogen atoms with a functional group such as alkyl or substituted carbonyl. Pharmaceutically acceptable prodrugs of compounds of Formula (I) or a form thereof include those compounds substituted with one or more of the following groups: carboxylic acid esters, sulfonate esters, amino acid esters, phosphonate esters and mono-, di- or triphosphate esters or alkyl substituents, where appropriate. As described herein, it is understood by a person of ordinary skill in the art that one or more of such substituents may be used to provide a compound of Formula (I) or a form thereof as a prodrug.

One or more compounds described herein may exist in unsolvated as well as solvated forms with pharmaceutically acceptable solvents such as water, ethanol, and the like, and the description herein is intended to embrace both solvated and unsolvated forms.

As used herein, the term "solvate" means a physical association of a compound described herein with one or more solvent molecules. This physical association involves varying degrees of ionic and covalent bonding, including hydrogen bonding. In certain instances the solvate will be capable of isolation, for example when one or more solvent molecules are incorporated in the crystal lattice of the crystalline solid. As used herein, "solvate" encompasses both solution-phase and isolatable solvates. Non-limiting examples of suitable solvates include ethanolates, methanolates, and the like.

As used herein, the term "hydrate" means a solvate wherein the solvent molecule is water.

The compounds of Formula (I) can form salts, which are intended to be included within the scope of this description. Reference to a compound of Formula (I) or a form thereof herein is understood to include reference to salt forms thereof, unless otherwise indicated. The term "salt(s)", as employed herein, denotes acidic salts formed with inorganic and/or organic acids, as well as basic salts formed with inorganic and/or organic bases. In addition, when a compound of Formula (I) or a form thereof contains both a basic moiety, such as, without limitation an amine moiety, and an acidic moiety, such as, but not limited to a carboxylic acid, zwitterions ("inner salts") may be formed and are included within the term "salt(s)" as used herein.

The term "pharmaceutically acceptable salt(s)", as used herein, means those salts of compounds described herein that are safe and effective (i.e., non-toxic, physiologically acceptable) for use in mammals and that possess biological activity, although other salts are also useful. Salts of the compounds of the Formula (I) may be formed, for example, by reacting a compound of Formula (I) or a form thereof with an amount of acid or base, such as an equivalent amount, in a medium such as one in which the salt precipitates or in an aqueous medium followed by lyophilization.

Pharmaceutically acceptable salts include one or more salts of acidic or basic groups present in compounds described herein. In certain aspects, acid addition salts may include, and are not limited to, acetate, ascorbate, benzoate, benzenesulfonate, bisulfate, bitartrate, borate, bromide, butyrate, chloride, citrate, camphorate, camphorsulfonate, ethanesulfonate, formate, fumarate, gentisinate, gluconate, glucaronate, glutamate, iodide, isonicotinate, lactate, maleate, methanesulfonate, naphthalenesulfonate, nitrate, oxalate, pamoate, pantothenate, phosphate, propionate, saccharate, salicylate, succinate, sulfate, tartrate, thiocyanate, toluenesulfonate (also known as tosylate), trifluoroacetate salts and the like. Certain aspects of acid addition salts may further include chloride, dichloride, trichloride, bromide, acetate, formate or trifluoroacetate salts.

Additionally, acids which are generally considered suitable for the formation of pharmaceutically useful salts from basic pharmaceutical compounds are discussed, for example, by P. Stahl et al, Camille G. (eds.) *Handbook of Pharmaceutical Salts. Properties, Selection and Use*. (2002) Zurich: Wiley-VCH; S. Berge et al, *Journal of Pharmaceutical Sciences* (1977) 66(1) 1-19; P. Gould, *International J. of Pharmaceutics* (1986) 33, 201-217; Anderson et al, *The Practice of Medicinal Chemistry* (1996), Academic Press, New York; and in *The Orange Book* (Food & Drug Administration, Washington, D.C. on their website). These disclosures are incorporated herein by reference thereto.

Suitable basic salts include, but are not limited to, aluminum, ammonium, calcium, lithium, magnesium, potassium, sodium and zinc salts.

All such acid salts and base salts are intended to be included within the scope of pharmaceutically acceptable salts as described herein. In addition, all such acid and base salts are considered equivalent to the free forms of the corresponding compounds for purposes of this description.

Compounds of Formula (I) and forms thereof, may further exist in a tautomeric form. All such tautomeric forms are contemplated and intended to be included within the scope of the compounds of Formula (I) or a form thereof as described herein.

The compounds of Formula (I) or a form thereof may contain asymmetric or chiral centers, and, therefore, exist in different stereoisomeric forms. The present description is intended to include all stereoisomeric forms of the compounds of Formula (I) as well as mixtures thereof, including racemic mixtures.

The compounds described herein may include one or more chiral centers, and as such may exist as racemic mixtures (R'S) or as substantially pure enantiomers and diastereomers. The compounds may also exist as substantially pure (R) or (S) enantiomers (when one chiral center is present). In one aspect, the compounds described herein are (S) isomers and may exist as enantiomerically pure compositions substantially comprising only the (S) isomer. In another aspect, the compounds described herein are (R) isomers and may exist as enantiomerically pure compositions substantially comprising only the (R) isomer. As one of skill in the art will recognize, when more than one chiral center is present, the compounds described herein may also exist as a (R,R), (R,S), (S,R) or (S,S) isomer, as defined by IUPAC Nomenclature Recommendations.

As used herein, the term "substantially pure" refers to compounds consisting substantially of a single isomer in an amount greater than or equal to 90%, in an amount greater than or equal to 92%, in an amount greater than or equal to 95%, in an amount greater than or equal to 98%, in an amount greater than or equal to 99%, or in an amount equal to 100% of the single isomer.

In one aspect of the description, a compound of Formula (I) or a form thereof is a substantially pure (S) enantiomer form present in an amount greater than or equal to 90%, in an amount greater than or equal to 92%, in an amount greater than or equal to 95%, in an amount greater than or equal to 98%, in an amount greater than or equal to 99%, or in an amount equal to 100%.

In another aspect provided herein are compounds of Formula (I) selected from a compound of Formula (Ia) and Formula (Ib) for use in the methods described herein:

In one aspect of the description, a compound of Formula (I) or a form thereof is a substantially pure (R) enantiomer form present in an amount greater than or equal to 90%, in an amount greater than or equal to 92%, in an amount greater than or equal to 95%, in an amount greater than or equal to 98%, in an amount greater than or equal to 99%, or in an amount equal to 100%.

In another aspect provided herein are compounds of Formula (I) selected from a compound of Formula (Ia) and Formula (Ib) for use in the methods described herein:

As used herein, a "racemate" is any mixture of isometric forms that are not "enantiomerically pure", including mixtures such as, without limitation, in a ratio of about 50/50, about 60/40, about 70/30, or about 80/20.

In another aspect provided herein are compounds of Formula (I) selected from a compound of Formula (Ia) and Formula (Ib) for use in the methods described herein:

In addition, the present description embraces all geometric and positional isomers. For example, if a compound of Formula (I) or a form thereof incorporates a double bond or a fused ring, both the cis- and trans-forms, as well as mixtures, are embraced within the scope of the description. Diastereomeric mixtures can be separated into their individual diastereomers on the basis of their physical chemical differences by methods well known to those skilled in the art, such as, for example, by chromatography and/or fractional crystallization. Enantiomers can be separated by use of chiral HPLC column or other chromatographic methods known to those skilled in the art. Enantiomers can also be separated by converting the enantiomeric mixture into a diastereomeric mixture by reaction with an appropriate optically active compound (e.g., chiral auxiliary such as a chiral alcohol or Mosher's acid chloride), separating the diastereomers and converting (e.g., hydrolyzing) the individual diastereomers to the corresponding pure enantiomers. Also, some of the compounds of Formula (I) may be atropisomers (e.g., substituted biaryls) and are considered as part of this description.

In another aspect provided herein are compounds of Formula (I) selected from a compound of Formula (Ia) and Formula (Ib) for use in the methods described herein:

All stereoisomers (for example, geometric isomers, optical isomers and the like) of the present compounds (including those of the salts, solvates, esters and prodrugs of the compounds as well as the salts, solvates and esters of the prodrugs), such as those which may exist due to asymmetric carbons on various substituents, including enantiomeric forms (which may exist even in the absence of asymmetric carbons), rotameric forms, atropisomers, and diastereomeric forms, are contemplated within the scope of this description, as are positional isomers (such as, for example, 4-pyridyl and 3-pyridyl). Individual stereoisomers of the compounds described herein may, for example, be substantially free of other isomers, or may be present in a racemic mixture, as described supra.

In another aspect provided herein are compounds of Formula (I) selected from a compound of Formula (Ia) and Formula (Ib) for use in the methods described herein:

The use of the terms "salt", "solvate", "ester", "prodrug" and the like, is intended to equally apply to the salt, solvate, ester and prodrug of enantiomers, stereoisomers, rotamers, tautomers, positional isomers, racemates or isotopologues of the instant compounds.

In another aspect provided herein are compounds of Formula (I) selected from a compound of Formula (Ia) and Formula (Ib) for use in the methods described herein:

The term "isotopologue" refers to isotopically-enriched compounds described herein which are identical to those recited herein, but for the fact that one or more atoms are replaced by an atom having an atomic mass or mass number different from the atomic mass or mass number usually found in nature. Examples of isotopes that can be incorporated into compounds described herein include isotopes of hydrogen, carbon, nitrogen, oxygen, phosphorus, fluorine and chlorine, such as $^2$H, $^3$H, $^{13}$C, $^{14}$C, $^{15}$N, $^{18}$O, $^{17}$O, $^{31}$P, $^{32}$P, $^{35}$S, $^{18}$F, $^{35}$Cl and $^{36}$Cl, respectively, each of which are also within the scope of this description.

In another aspect provided herein are compounds of Formula (I) selected from a compound of Formula (Ia) and Formula (Ib) for use in the methods described herein:

Certain isotopically-enriched compounds described herein (e.g., those labeled with $^3$H and $^{14}$C) are useful in compound and/or substrate tissue distribution assays. Tritiated (i.e., $^3$H) and carbon-14 (i.e., $^{14}$C) isotopes are particularly preferred for their ease of preparation and detectability. Further, substitution with heavier isotopes such as deuterium (i.e., $^2$H) may afford certain therapeutic advantages resulting from greater metabolic stability (e.g., increased in vivo half-life or reduced dosage requirements) and hence may be preferred in some circumstances.

In another aspect provided herein are compounds of Formula (I) selected from a compound of Formula (Ia) and Formula (Ib) for use in the methods described herein: polymorphic crystalline and amorphous forms of the compounds of Formula (I) and of the salts, solvates, hydrates, esters and prodrugs of the compounds of Formula (I) are further intended to be included in the present description.

Compound names provided herein were obtained using ACD Labs Index Name software provided by ACD Labs and/or ChemDraw Ultra software provided by CambridgeSoft®. When the compound name disclosed herein conflicts with the structure depicted, the structure shown will supercede the use of the name to define the compound intended. Nomenclature for substituent radicals defined herein may differ slightly from the chemical name from which they are derived; one skilled in the art will recognize that the definition of the substituent radical is intended to include the radical as found in the chemical name.

As used herein the term "aberrant" refers to a deviation from the norm of, e.g., the average healthy subject or a cell(s) or tissue sample from a healthy subject. The term "aberrant expression," as used herein, refers to abnormal expression (up-regulated or down-regulated resulting in an excessive or deficient amount thereof) of a gene product (e.g., RNA transcript or protein) by a cell, tissue sample, or subject relative to a corresponding normal, healthy cell, tissue sample or subject. In a specific aspect, the "aberrant expression" refers to an altered level of a gene product (e.g., RNA transcript or protein) in a cell, tissue sample, or subject relative to a corresponding normal, healthy cell, tissue sample or subject. The term "aberrant amount" as used herein refers to an altered level of a gene product (e.g., RNA, protein, polypeptide, or peptide) in a cell, tissue sample, or subject relative to a corresponding normal, healthy cell, tissue sample or subject. In specific aspects, the amount of a gene product (e.g., RNA, protein, polypeptide, or peptide) in a cell, tissue sample, or subject relative to a corresponding cell or tissue sample from a healthy subject or a healthy subject, is considered aberrant if it is 1, 1.5, 2, 2.5, 3, 3.5, 4, 4.5, 5, 5.5, 6-fold or more above or below the amount of the gene product in the corresponding cell or tissue sample from a healthy subject or healthy subject.

The term "intronic REMS" refers to a REMS sequence present in an intron that functions as a 5' splice site in the presence of a compound described herein. The intronic REMS, when downstream of a first branch point (BP) sequence and a first 3' splice site (3' ss) sequence and upstream of a second branch point (BP) sequence and a second 3' splice site (3' ss) sequence) (as shown in FIG. 1A) and in the presence of a compound described herein, functions as a 5' splice site. The intronic REMS may also function as a 5' splice site when upstream of a branch point and a 3' splice site in the presence of a compound described herein (see FIG. 1B or 1C) and the minimally required elements are present. Any one, two, three, or more or all of the following may be present endogenously or non-endogenously in the affected intron: the intronic REMS, the first BP, the second BP, the first 3' ss, and the second 3' ss. The minimally required additional elements necessary for an intronic REMS to function as a 5' splice site comprises a downstream branch point (BP) sequence and a downstream 3' splice site (3' ss) sequence. Either or both the BP and 3' ss may be present endogenously or non-endogenously in the affected intron.

As used herein, a "non-endogenous" nucleotide sequence (such as a non-endogenous 5' splice site, a non-endogenous branch point or a non-endogenous 3' splice site) is a nucleotide sequence not naturally found to be part of a pre-RNA or a DNA sequence encoding a pre-RNA sequence. In other words, the hand of man is required to synthesize or manipulate the RNA or DNA sequence to introduce the nucleotide sequence.

As used herein, the term "non-endogenous intronic REMS" refers to a REMS sequence not naturally found to be part of an RNA sequence or naturally encoded by a DNA sequence. In other words, the hand of man is required to synthesize or manipulate the RNA or DNA sequence to introduce the intronic REMS or the nucleotide sequence encoding the intronic REMS.

As used herein, the terms "intron-derived exon," "intronic exon," "iExon" and "intronic exon" (collectively iExon) refer to an exon that is produced from an intronic RNA sequence when an intronic REMS sequence, a branch point, a 3' splice site and a splicing modifier compound are present. In particular, when RNA splicing of an RNA transcript comprising two exons and an intron occurs in the presence of a compound described herein, wherein a first exon is upstream of the intron and a second exon is downstream of the intron, and wherein the intron comprises in 5' to 3' order: a first 5' splice site, a first branch point, a first 3' splice site, an iREMS, a second branch point, and a second 3' splice site, a resulting iExon comprises the following RNA sequence: the RNA sequence between the first 3' splice site and the iREMS (corresponding to iExon 1a as shown in FIG. 1A). One or more of the intronic REMS sequence, branch point and 3' splice site may be naturally present in an intronic RNA sequence or may be introduced into the intronic RNA sequence. When all such elements are present or introduced, in the presence of a compound described herein, the elements define an exonic boundary that enables the splicing machinery to generate an iExon in RNA, a result that would not naturally occur without the addition of a splicing modifier compound.

As used herein, the term "pseudoexon" refers to known endogenous intronic sequences naturally present in intron coding DNA that may match those of a branch point, a 3' splice site and a 5' splice site, yet is neither active in the splicing process, spliced nor present in the mature mRNA. Some pseudoexons contain an intronic REMS at their 5' splice site. An intronic REMS-containing pseudoexon is not known to be endogenously recognized by the splicing machinery for producing an iExon but in the presence of a splicing modifier compound as described herein, the splicing machinery produces an iExon. Accordingly, production of an iExon from a pseudoexon is intended to be included within the scope of various aspects of the collective term "iExon."

As used herein, the term "unannotated exon" refers to endogenous sequences that are naturally present as exons in mature mRNA product according to experimental evidence but are not annotated in NCBI's RefSeq database (https://www.ncbi.nlm.nih.gov/refseq/). Some unannotated exons contain an intronic REMS at the 5' splice site. A REMS-containing unannotated exon is not known to be endogenously recognized by the splicing machinery for producing an iExon, but in the presence of a splicing modifier compound as described herein, the splicing machinery produces an iExon. Accordingly, production of an iExon from an unannotated exon is intended to be included within the scope of various aspects of the collective term "iExon."

Figure 1B:
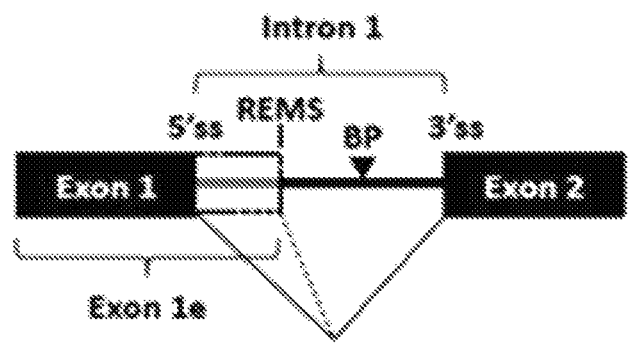
Figure 1C:
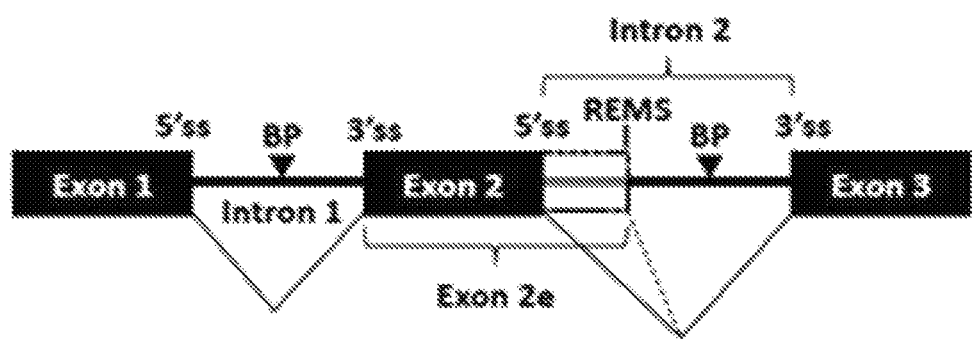
Figure 5A:
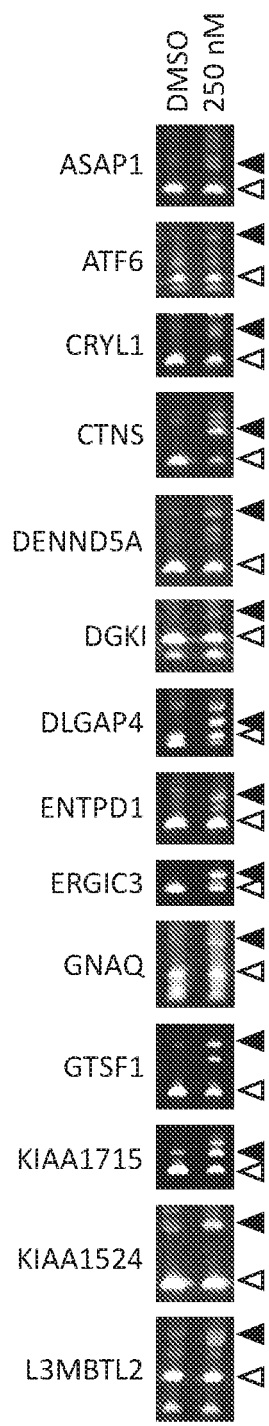
Figure 5B:
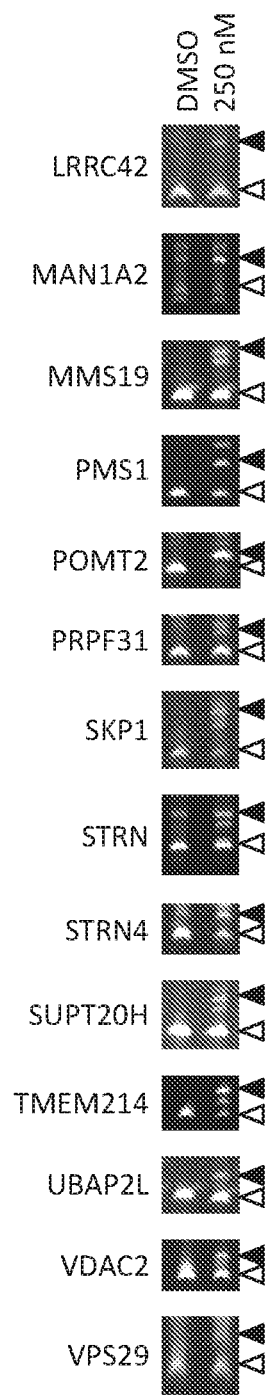

As used herein, the terms "extended exon" (i.e., eExon) refer to an exon that includes an exon and a portion of an adjacent intronic sequence when an intronic REMS sequence, a branch point, a 3' splice site and a splicing modifier compound are present in, e.g., the order shown in FIG. 1B. In particular, when RNA splicing of an RNA transcript comprising two exons and an intron occurs in the presence of a compound described herein, wherein a first exon is upstream of the intron and a second exon is downstream of the intron, and wherein the intron comprises in 5' to 3' order: a 5' splice site, an iREMS, a branch point, and a 3' splice site, and wherein there is no intervening branch point and no intervening 3' splice site between the iREMS sequence and the 5' splice site, a resulting eExon comprises the first exon and the RNA sequence between the 5' splice site and the intronic REMS (corresponding to Exon 1e as shown in FIG. 1B, and Exon 2e as shown in FIG. 1C).

As used herein, the term "substantial change" in the context of the amount of one or more RNA transcripts (e.g., rRNA, tRNA, miRNA, siRNA, piRNA, lncRNA, pre-mRNA or mRNA transcripts), an alternative splice variant thereof or an isoform thereof, or one or more proteins thereof, each expressed as the product of one or more of genes, means that the amount of such products changes by a statistically significant amount such as, in a nonlimiting example, a p value less than a value selected from 0.1, 0.01, 0.001, or 0.0001.

As used herein, the terms "subject" and "patient" are used interchangeably to refer to an animal or any living organism having sensation and the power of voluntary movement, and which requires for its existence oxygen and organic food. Non-limiting examples include members of the human, equine, porcine, bovine, rattus, murine, canine and feline species. In some aspects, the subject is a mammal or a warm-blooded vertebrate animal. In certain aspects, the subject is a non-human animal. In specific aspects, the subject is a human.

As used herein, the term "functional protein" refers to a form of a protein that retains a certain biological function or the functions of a full-length protein or protein isoform encoded by a gene.

As used herein, the term "non-functional protein" refers to a form of a protein that does not retain any biological function compared to full length protein or a protein isoform encoded by a gene in the absence of a splicing modifier compound as described herein.

As used herein, in the context of a functional protein produced from an artificial construct, the term "produce substantially less" means that the amount of functional protein produced in the presence of a compound described herein is at least substantially 20%, 25%, 30%, 35%, 40%, 45%, 50%, 55%, 60%, 70%, 75%, 80%, 85%, 90%, 95%, 98%, or 100% less than the amount of functional protein produced in the absence of the compound.

Methods for Determining Whether Expression of a Gene May be Modulated or Modified by the Compounds In another aspect, provided herein are methods for determining whether the splicing of the precursor RNA of a gene is likely to be modified by a compound of Formula (I) or a form thereof, comprising searching for the presence of an intronic REMS (i.e., a sequence functioning as a 5' splice site responsive to the presence of compound) in a gene intronic sequence, wherein the presence of the intronic REMS, 3' splice site and an intronic branch point in the gene sequence indicates that the splicing of the precursor RNA of the gene is likely to be modified by the compound of Formula (I) or a form thereof, and the absence of the intronic REMS and an intronic 3' splice site and an intronic branch point in the gene sequence indicates that the splicing of the precursor RNA of the gene is unlikely to be modified by the compound of Formula (I) or a form thereof. In specific aspects, the methods further comprise searching for the presence of the combination of an intronic REMS, an intronic 3' splice site and an intronic branch point in the gene sequence.

In another aspect, provided herein are methods for determining whether the amount of a product (e.g., an mRNA transcript or protein) of a gene is likely to be modulated by a compound of Formula (I) or a form thereof, comprising searching for the presence of an intronic REMS in the gene sequence, wherein the presence of the combination of an intronic REMS, an intronic 3' splice site and an intronic branch point in the gene sequence indicates that the amount of a product (e.g., an mRNA transcript or protein) of the gene is likely to be modulated by the compound of Formula (I) or a form thereof, and the absence of the combination of an intronic REMS, an intronic 3' splice site and an intronic branch point in the gene sequence indicates that the amount of a product (e.g., an mRNA transcript or protein) of the gene is unlikely to be modulated by the compound of Formula (I) or a form thereof. In specific aspects, the methods further comprise searching for the presence of any of an intronic REMS, an intronic 3' splice site, and an intronic branch point in the gene sequence. In specific aspects, the methods further comprise searching for the presence of the combination of an intronic REMS, a downstream branch point and a downstream 3' splice site in the gene sequence.

The step of searching for the presence of the minimally required combination of an intronic REMS, a downstream 3' splice site, and a downstream branch point in the gene sequence described herein can be performed by a computer system comprising a memory storing instructions for searching for the presence of the combination in the gene sequence, or such a search can be performed manually.

In certain aspects, the splicing of a precursor RNA containing an intronic REMS is assessed by contacting a compound described herein with the precursor RNA in cell culture. In some aspects, the splicing of a precursor RNA containing an intronic REMS is assessed by contacting a compound described herein with the precursor RNA in a cell-free extract. In a specific aspect, the compound is one known to modulate the splicing of a precursor RNA containing an intronic REMS. See, e.g., the section below relating to methods for determining whether a compound modulates the expression of certain genes, and the example below for techniques that could be used in these assessments.

Methods for Determining which Compounds Modulate or Modify Expression of Certain Genes Provided herein are methods for determining whether a compound of Formula (I) or a form thereof modulates the amount of one, two, three or more RNA transcripts (e.g., pre-mRNA or mRNA transcripts or isoforms thereof) of one, two, three or more genes. In some aspects, the gene is any one of the genes described herein.

In one aspect, provided herein is a method for determining whether a compound of Formula (I) or a form thereof modulates the amount of an RNA transcript, comprising: (a) contacting a cell(s) with a compound of Formula (I) or a form thereof, and (b) determining the amount of the RNA transcript produced by the cell(s), wherein modulation in the amount of the RNA transcript in the presence of the compound relative to the amount of the RNA transcript in the absence of the compound or the presence of a negative control (e.g., a vehicle control such as PBS or DMSO) indicates that the compound of Formula (I) or a form thereof modulates the amount of the RNA transcript. In another aspect, provided herein is a method for determining whether a compound of Formula (I) or a form thereof modulates the amount of an RNA transcript (e.g., an mRNA transcript), comprising: (a) contacting a first cell(s) with a compound of Formula (I) or a form thereof, (b) contacting a second cell(s) with a negative control (e.g., a vehicle control, such as PBS or DMSO); and (c) determining the amount of the RNA transcript produced by the first cell(s) and the second cell(s); and (d) comparing the amount of the RNA transcript produced by the first cell(s) to the amount of the RNA transcript expressed by the second cell(s), wherein modulation in the amount of the RNA transcript produced by the first cell(s) relative to the amount of the RNA transcript produced by the second cell(s) indicates that the compound of Formula (I) or a form thereof modulates the amount of the RNA transcript. In certain aspects, the contacting of the cell(s) with the compound occurs in cell culture. In other aspects, the contacting of the cell(s) with the compound occurs in a subject, such as a non-human animal subject.

In another aspect, provided herein is a method for determining whether a compound of Formula (I) or a form thereof modifies the splicing of an RNA transcript (e.g., an mRNA transcript), comprising: (a) culturing a cell(s) in the presence of a compound of Formula (I) or a form thereof; and (b) determining the amount of the two or more RNA transcript splice variants produced by the cell(s), wherein modulation in the amount of the two or more RNA transcript in the presence of the compound relative to the amount of the two or more RNA transcript splice variants in the absence of the compound or the presence of a negative control (e.g., a vehicle control such as PBS or DMSO) indicates that the compound of Formula (I) or a form thereof modifies the splicing of the RNA transcript.

In another aspect, provided herein is a method for determining whether a compound of Formula (I) or a form thereof modifies the splicing of an RNA transcript (e.g., an mRNA transcript), comprising: (a) culturing a cell(s) in the presence of a compound of Formula (I) or a form thereof; (b) isolating two or more RNA transcript splice variants from the cell(s) after a certain period of time; and (c) determining the amount of the two or more RNA transcript splice variants produced by the cell(s), wherein modulation in the amount of the two or more RNA transcript in the presence of the compound relative to the amount of the two or more RNA transcript splice variants in the absence of the compound or the presence of a negative control (e.g., a vehicle control such as PBS or DMSO) indicates that the compound of Formula (I) or a form thereof modifies the splicing of the RNA transcript. In another aspect, provided herein is a method for determining whether a compound of Formula (I) or a form thereof modifies the splicing of an RNA transcript (e.g., an mRNA transcript), comprising (a) culturing a first cell(s) in the presence of a compound of Formula (I) or a form thereof; (b) culturing a second cell(s) in the presence of a negative control (e.g., a vehicle control, such as PBS or DMSO); (c) isolating two or more RNA transcript splice variants produced by the first cell(s) and isolating two or more RNA transcript splice variants produced by the second cell(s); (d) determining the amount of the two or more RNA transcript splice variants produced by the first cell(s) and the second cell(s); and (e) comparing the amount of the two or more RNA transcript splice variants produced by the first cell(s) to the amount of the two or more RNA transcript splice variants produced by the second cell(s), wherein modulation in the amount of the two or more RNA transcript splice variants produced by the first cell(s) relative to the amount of the two or more RNA transcript splice variants produced by the second cell(s) indicates that the compound of Formula (I) or a form thereof modulates the splicing of the RNA transcript.

In another aspect, provided herein is a method for determining whether a compound of Formula (I) or a form thereof modulates the amount of an RNA transcript (e.g., an mRNA transcript), comprising: (a) contacting a cell-free system with a compound of Formula (I) or a form thereof, and (b) determining the amount of the RNA transcript produced by the cell-free system, wherein modulation in the amount of the RNA transcript in the presence of the compound relative to the amount of the RNA transcript in the absence of the compound or the presence of a negative control (e.g., a vehicle control such as PBS or DMSO) indicates that the compound of Formula (I) or a form thereof modulates the amount of the RNA transcript. In another aspect, provided herein is a method for determining whether a compound of Formula (I) or a form thereof modulates the amount of an RNA transcript (e.g., an mRNA transcript), comprising: (a) contacting a first cell-free system with a compound of Formula (I) or a form thereof, (b) contacting a second cell-free system with a negative control (e.g., a vehicle control, such as PBS or DMSO): and (c) determining the amount of the RNA transcript produced by the first cell-free system and the second cell-free system; and (d) comparing the amount of the RNA transcript produced by the first cell-free system to the amount of the RNA transcript expressed by the second cell-free system, wherein modulation in the amount of the RNA transcript produced by the first cell-free system relative to the amount of the RNA transcript produced by the second cell-free system indicates that the compound of Formula (I) or a form thereof modulates the amount of the RNA transcript. In certain aspects, the cell-free system comprises purely synthetic RNA, synthetic or recombinant (purified) enzymes, and protein factors. In other aspects, the cell-free system comprises RNA transcribed from a synthetic DNA template, synthetic or recombinant (purified) enzymes, and protein factors. In other aspects, the cell-free system comprises purely synthetic RNA and nuclear extract. In other aspects, the cell-free system comprises RNA transcribed from a synthetic DNA template and nuclear extract. In other aspects, the cell-free system comprises purely synthetic RNA and whole cell extract. In other aspects, the cell-free system comprises RNA transcribed from a synthetic DNA template and whole cell extract. In certain aspects, the cell-free system additionally comprises regulatory RNAs (e.g., microRNAs).

In another aspect, provided herein is a method for determining whether a compound of Formula (I) or a form thereof modifies the splicing of an RNA transcript (e.g., an mRNA transcript), comprising: (a) contacting a cell-free system with a compound of Formula (I) or a form thereof; and (b) determining the amount of two or more RNA transcript splice variants produced by the cell-free system, wherein modulation in the amount of the two or more RNA transcript splice variants in the presence of the compound relative to the amount of the two or more RNA transcript splice variants in the absence of the compound or the presence of a negative control (e.g., a vehicle control such as PBS or DMSO) indicates that the compound of Formula (I) or a form thereof modifies the splicing of the RNA transcript. In another aspect, provided herein is a method for determining whether a compound of Formula (I) or a form thereof modifies the splicing of an RNA transcript (e.g., an mRNA transcript), comprising: (a) contacting a first cell-free system with a compound of Formula (I) or a form thereof; (b) contacting a second cell-free system with a negative control (e.g., a vehicle control, such as PBS or DMSO); and (c) determining the amount of two or more RNA transcript splice variants produced by the first cell-free system and the second cell-free system; and (d) comparing the amount of the two or more RNA transcript splice variants produced by the first cell-free system to the amount of the RNA transcript expressed by the second cell-free system, wherein modulation in the amount of the two or more RNA transcript splice variants produced by the first cell-free system relative to the amount of the two or more RNA transcript splice variants produced by the second cell-free system indicates that the compound of Formula (I) or a form thereof modifies the splicing of the RNA transcript. In certain aspects, the cell-free system comprises purely synthetic RNA, synthetic or recombinant (purified) enzymes, and protein factors. In other aspects, the cell-free system comprises RNA transcribed from a synthetic DNA template, synthetic or recombinant (purified) enzymes, and protein factors. In other aspects, the cell-free system comprises purely synthetic RNA and nuclear extract. In other aspects, the cell-free system comprises RNA transcribed from a synthetic DNA template and nuclear extract. In other aspects, the cell-free system comprises purely synthetic RNA and whole cell extract. In other aspects, the cell-free system comprises RNA transcribed from a synthetic DNA template and whole cell extract. In certain aspects, the cell-free system additionally comprises regulatory RNAs (e.g., microRNAs).

In another aspect, provided herein is a method for determining whether a compound of Formula (I) or a form thereof modulates the amount of an RNA transcript (e.g., an mRNA transcript), comprising: (a) culturing a cell(s) in the presence of a compound of Formula (I) or a form thereof, (b) isolating the RNA transcript from the cell(s) after a certain period of time; and (c) determining the amount of the RNA transcript produced by the cell(s), wherein modulation in the amount of the RNA transcript in the presence of the compound relative to the amount of the RNA transcript in the absence of the compound or the presence of a negative control (e.g., a vehicle control such as PBS or DMSO) indicates that the compound of Formula (I) or a form thereof modulates the amount of the RNA transcript. In another aspect, provided herein is a method for determining whether a compound of Formula (I) or a form thereof modulates the amount of an RNA transcript (e.g., an mRNA transcript), comprising (a) culturing a first cell(s) in the presence of a compound of Formula (I) or a form thereof, (b) culturing a second cell(s) in the presence of a negative control (e.g., a vehicle control, such as PBS or DMSO); (c) isolating the RNA transcript produced by the first cell(s) and isolating the RNA transcript produced by the second cell(s); (d) determining the amount of the RNA transcript produced by the first cell(s) and the second cell(s); and (e) comparing the amount of the RNA transcript produced by the first cell(s) to the amount of the RNA transcript produced by the second cell(s), wherein modulation in the amount of the RNA transcript produced by the first cell(s) relative to the amount of the RNA transcript produced by the second cell(s) indicates that the compound of Formula (I) or a form thereof modulates the amount of the RNA transcript.

In certain aspects, the cell(s) contacted or cultured with a compound of Formula (I) or a form thereof is a primary cell(s) from a subject. In some aspects, the cell(s) contacted or cultured with a compound of Formula (I) or a form thereof is a primary cell(s) from a subject with a disease. In specific aspects, the cell(s) contacted or cultured with a compound of Formula (I) or a form thereof is a primary cell(s) from a subject with a disease associated with an aberrant amount of an RNA transcript(s) for a particular gene(s). In some specific aspects, the cell(s) contacted or cultured with a compound of Formula (I) or a form thereof is a primary cell(s) from a subject with a disease associated with an aberrant amount of an isoform(s) of a particular gene(s). In some aspects, the cell(s) contacted or cultured with a compound of Formula (I) or a form thereof is a fibroblast (e.g., GM03813 or PNN 1-46 fibroblasts), an immune cell (e.g., a T cell, B cell, natural killer cell, macrophage), or a muscle cell. In certain aspects, the cell(s) contacted or cultured with a compound of Formula (I) or a form thereof is a cancer cell.

In certain aspects, the cell(s) contacted or cultured with a compound of Formula (I) or a form thereof is from a cell line. In some aspects, the cell(s) contacted or cultured with a compound of Formula (I) or a form thereof is a cell line derived from a subject with a disease. In certain aspects, the cell(s) contacted or cultured with a compound of Formula (I) or a form thereof is from a cell line known to have aberrant RNA transcript levels for a particular gene(s). In specific aspects, the cell(s) contacted or cultured with a compound of Formula (I) or a form thereof is from a cell line derived from a subject with a disease known to have aberrant RNA transcript levels for a particular gene(s). In certain aspects, the cell(s) contacted or cultured with a compound of Formula (I) or a form thereof is a cancer cell line.

In some specific aspects, the cell(s) contacted or cultured with the compound of Formula (I) or a form thereof is from a cell line derived from a subject with a disease known to have an aberrant amount of an RNA isoform(s) and/or protein isoform(s) of a particular gene(s). Non-limiting examples of cell lines include 3T3, 4T1, 721, 9L, A2780, A172, A20, A253, A431, A-549, ALC, B16, B35, BCP-1, BEAS-2B, bEnd.3, BHK, BR 293, BT20, BT483, BxPC3, C2C12, C3H-10T1/2, C6/36, C6, Cal-27, CHO, COR-L23, COS, COV-434, CML T1, CMT, CRL7030, CT26, D17, DH82, DU145, DuCaP, EL4, EM2, EM3, EMT6, FM3, H1299, H69, HB54, HB55, HCA2, HD-1994, HDF (human dermal fibroblasts), HEK-293, HeLa, Hepa1c1c7, HL-60, HMEC, Hs578T, HsS78Bst, HT-29, HTB2, HUVEC, Jurkat, J558L, JY, K562, Ku812, KCL22, KG1, KYO1, LNCap, Ma-Mel, MC-38, MCF-7, MCF-10A, MDA-MB-231, MDA-MB-468, MDA-MB-435, MDCK, MG63, MOR/0.2R, MONO-MAC 6, MRC5, MTD-1A, NCI-H69, NIH-3T3, NALM-1, NSO, NW-145, OPCN, OPCT, PNT-1A, PNT-2, Raji, RBL, RenCa, RIN-5F, RMA, Saos-2, Sf21, Sf9, SH-SY5Y, SiHa, SKBR3, SKOV-3, T2, T-47D, T84, THP1, U373, U87, U937, VCaP, Vero, VERY, W138, WM39, WT-49, X63, YAC-1, and YAR cells. In one aspect, the cells are from a patient. In another aspect, the patient cells are GM03813 cells. In another aspect, the patient cells are GM04856, GM04857, GM9197, GM04281, GM04022, GM07492 cells.

In another aspect, provided herein is a method for determining whether a compound of Formula (I) or a form thereof modulates the amount of an RNA transcript (e.g., an mRNA transcript), comprising: (a) contacting a tissue sample with a compound of Formula (I) or a form thereof; and (b) determining the amount of the RNA transcript produced by the tissue sample, wherein modulation in the amount of the RNA transcript in the presence of the compound relative to the amount of the RNA transcript in the absence of the compound or the presence of a negative control (e.g., a vehicle control such as PBS or DMSO) indicates that the compound of Formula (I) or a form thereof modulates the amount of the RNA transcript. In another aspect, provided herein is a method for determining whether a compound of Formula (I) or a form thereof modulates the amount of an RNA transcript (e.g., an mRNA transcript), comprising: (a) contacting a first tissue sample with a compound of Formula (I) or a form thereof, (b) contacting a second tissue sample with a negative control (e.g., a vehicle control, such as PBS or DMSO); and (c) determining the amount of the RNA transcript produced by the first tissue sample and the second tissue sample; and (d) comparing the amount of the RNA transcript produced by the first tissue sample to the amount of the RNA transcript produced by the second tissue sample, wherein modulation in the amount of the RNA transcript produced by the first tissue sample relative to the amount of the RNA transcript produced by the second tissue sample indicates that the compound of Formula (I) or a form thereof modulates the amount of the RNA transcript. Any tissue sample containing cells may be used in the accordance with these methods. In certain aspects, the tissue sample is a blood sample, a skin sample, a muscle sample, or a tumor sample. Techniques known to one skilled in the art may be used to obtain a tissue sample from a subject.

In some aspects, a dose-response assay is performed. In one aspect, the dose response assay comprises: (a) contacting a cell(s) with a concentration of a compound of Formula (I) or a form thereof; (b) determining the amount of the RNA transcript produced by the cell(s), wherein modulation in the amount of the RNA transcript in the presence of the compound relative to the amount of the RNA transcript in the absence of the compound or the presence of a negative control (e.g., a vehicle control such as PBS or DMSO) indicates that the compound of Formula (I) or a form thereof modulates the amount of the RNA transcript; (c) repeating steps (a) and (b), wherein the only experimental variable changed is the concentration of the compound or a form thereof; and (d) comparing the amount of the RNA transcript produced at the different concentrations of the compound or a form thereof. In another aspect, the dose response assay comprises: (a) culturing a cell(s) in the presence of a compound of Formula (I) or a form thereof; (b) isolating the RNA transcript from the cell(s) after a certain period; (c) determining the amount of the RNA transcript produced by the cell(s), wherein modulation in the amount of the RNA transcript in the presence of the compound relative to the amount of the RNA transcript in the absence of the compound or the presence of a negative control (e.g., a vehicle control such as PBS or DMSO) indicates that the compound of Formula (I) or a form thereof modulates the amount of the RNA transcript; (d) repeating steps (a), (b), and (c), wherein the only experimental variable changed is the concentration of the compound or a form thereof; and (e) comparing the amount of the RNA transcript produced at the different concentrations of the compound or a form thereof. In another aspect, the dose-response assay comprises: (a) contacting each well of a microtiter plate containing cells with a different concentration of a compound of Formula (I) or a form thereof: (b) determining the amount of an RNA transcript produced by cells in each well; and (c) assessing the change of the amount of the RNA transcript at the different concentrations of the compound or form thereof.

In one aspect, the dose response assay comprises: (a) contacting a cell(s) with a concentration of a compound of Formula (I) or a form thereof, wherein the cells are within the wells of a cell culture container (e.g., a 96-well plate) at about the same density within each well, and wherein the cells are contacted with different concentrations of compound in different wells; (b) isolating the RNA from said cells in each well; (c) determining the amount of the RNA transcript produced by the cell(s) in each well; and (d) assessing change in the amount of the RNA transcript in the presence of one or more concentrations of compound relative to the amount of the RNA transcript in the presence of a different concentration of the compound or the absence of the compound or the presence of a negative control (e.g., a vehicle control such as PBS or DMSO).

In certain aspects, the contacting of the cell(s) with the compound occurs in cell culture. In other aspects, the contacting of the cell(s) with the compound occurs in a subject, such as a non-human animal subject.

In certain aspects described herein, the cell(s) is contacted or cultured with a compound of Formula (I) or a form thereof, or a tissue sample is contacted with a compound of Formula (I) or a form thereof, or a negative control for a period of 15 minutes, 30 minutes, 45 minutes, 1 hour, 2 hours, 3 hours, 4 hours, 5 hours, 6 hours, 8 hours, 12 hours, 18 hours, 24 hours, 48 hours, 72 hours or longer. In other aspects described herein, the cell(s) is contacted or cultured with a compound of Formula (I) or a form thereof, or a tissue sample is contacted with a compound of Formula (I) or a form thereof, or a negative control for a period of 15 minutes to 1 hour, 1 to 2 hours, 2 to 4 hours, 6 to 12 hours, 12 to 18 hours, 12 to 24 hours, 28 to 24 hours, 24 to 48 hours, 48 to 72 hours.

In certain aspects described herein, the cell(s) is contacted or cultured with a certain concentration of a compound of Formula (I) or a form thereof, or a tissue sample is contacted with a certain concentration of a compound of Formula (I) or a form thereof, wherein the certain concentration is 0.0001 µM, 0.0003 µM, 0.001 µM, 0.003 µM, 0.01 µM, 0.05 µM, 1 µM, 2 µM, 5 µM, 10 µM, 15 µM, 20 µM, 25 µM, 50 µM, 75 µM, 100 µM, or 150 µM. In other aspects described herein, the cell(s) is contacted or cultured with a certain concentration of a compound of Formula (I) or a form thereof, or a tissue sample is contacted with a certain concentration of a compound of Formula (I) or a form thereof, wherein the certain concentration is 0.0001 µM, 0.0003 µM, 0.0005 µM, 0.001 µM, 0.003 µM, 0.005 µM, 0.01 µM, 0.03 µM, 0.05 µM, 0.1 µM, 0.3 µM, 0.5 µM or 1 µM. In other aspects described herein, the cell(s) is contacted or cultured with a certain concentration of a compound of Formula (I) or a form thereof, or a tissue sample is contacted with a certain concentration of a compound of Formula (I) or a form thereof, wherein the certain concentration is 175 µM, 200 µM, 250 µM, 275 µM, 300 µM, 350 µM, 400 µM, 450 µM, 500 µM, 550 µM, 600 µM, 650 µM, 700 µM, 750 µM, 800 µM, 850 µM, 900 µM, 950 µM or 1 mM. In some aspects described herein, the cell(s) is contacted or cultured with a certain concentration of a compound of Formula (I) or a form thereof, or a tissue sample is contacted with a certain concentration of a compound of Formula (I) or a form thereof, wherein the certain concentration is 5 nM, 10 nM, 20 nM, 30 nM, 40 nM, 50 nM, 60 nM, 70 nM, 80 nM, 90 nM, 100 nM, 150 nM, 200 nM, 250 nM, 300 nM, 350 nM, 400 nM, 450 nM, 500 nM, 550 nM, 600 nM, 650 nM, 700 nM, 750 nM, 800 nM, 850 nM, 900 nM, or 950 nM. In certain aspects described herein, the cell(s) is contacted or cultured with a certain concentration of a compound of Formula (I) or a form thereof, or a tissue sample is contacted with a certain concentration of a compound of Formula (I) or a form thereof, wherein the certain concentration is between 0.0001 µM to 0.001 µM, 0.0001 µM to 0.01 µM, 0.0003 µM to 0.001 µM, 0.0003 µM to 0.01 µM, 0.001 µM to 0.01 µM, 0.003 µM to 0.01 µM, 0.01 µM to 0.1 µM, 0.1 µM to 1 µM, 1 µM to 50 µM, 50 µM to 100 µM, 100 µM to 500 µM, 500 µM to 1 nM, 1 nM to 10 nM, 10 nM to 50 nM, 50 nM to 100 nM, 100 nM to 500 nM, 500 nM to 1000 nM.

In another aspect, provided herein is a method for determining whether a compound of Formula (I) or a form thereof modulates the amount of an RNA transcript (e.g., an mRNA transcript), comprising: (a) administering a compound of Formula (I) or a form thereof to a subject (in certain aspects, a non-human animal); and (b) determining the amount of the RNA transcript in a sample obtained from the subject, wherein modulation in the amount of the RNA transcript measured in the sample from the subject administered the compound or form thereof relative to the amount of the RNA transcript in a sample from the subject prior to administration of the compound or form thereof or a sample from a different subject from the same species not administered the compound or form thereof indicates that the compound of Formula (I) or a form thereof modulates the amount of the RNA transcript. In another aspect, provided herein is a method for determining whether a compound of Formula (I) or a form thereof modulates the amount of an RNA transcript (e.g., an mRNA transcript), comprising: (a) administering a compound of Formula (I) or a form thereof to a first subject (in certain aspects, a non-human animal); (b) administering an inactive control (e.g., a pharmaceutical carrier) to a second subject (in certain aspects, a non-human animal) of the same species as the first subject; and (c) determining the amount of the RNA transcript in a first tissue sample from the first subject and the amount of the RNA transcript in the second tissue sample from the second subject; and (d) comparing the amount of the RNA transcript in the first tissue sample to the amount of the RNA transcript in the second tissue sample, wherein modulation in the amount of the RNA transcript in the first tissue sample relative to the amount of the RNA transcript in the second tissue sample indicates that the compound of Formula (I) or a form thereof modulates the amount of the RNA transcript. In certain aspects, a compound of Formula (I) or form thereof is administered to a subject at a dose of about 0.001 mg/kg/day to about 500 mg/kg/day. In some aspects, a single dose of a compound of Formula (I) or a form thereof is administered to a subject in accordance with the methods described herein. In other aspects, 2, 3, 4, 5 or more doses of a compound of Formula (I) is administered to a subject in accordance with the methods described herein. In specific aspects, the compound of Formula (I) or a form thereof is administered in a subject in a pharmaceutically acceptable carrier, excipient or diluent.

In another aspect, provided herein is a method for determining whether a compound of Formula (I) or a form thereof modifies the splicing of an RNA transcript (e.g., an mRNA transcript), comprising: (a) administering a compound of Formula (I) or a form thereof to a subject (in certain aspects, a non-human animal); and (b) determining the amount of two or more RNA transcript splice variants in a sample obtained from the subject, wherein modulation in the amount of the two or more RNA transcript splice variants measured in the sample from the subject administered the compound or form thereof relative to the amount of the two or more RNA transcript splice variants in a sample from the subject prior to administration of the compound or form thereof or a sample from a different subject from the same species not administered the compound or form thereof indicates that the compound of Formula (I) or a form thereof modifies the splicing of the RNA transcript. In another aspects, provided herein is a method for determining whether a compound of Formula (I) or a form thereof modifies the splicing of an RNA transcript (e.g., an mRNA transcript), comprising: (a) administering a compound of Formula (I) or a form thereof to a first subject (in certain aspects, a non-human animal); (b) administering a negative control (e.g., a pharmaceutical carrier) to a second subject (in certain aspects, a non-human animal) of the same species as the first subject; (c) determining the amount of two or more RNA transcript splice variants in a first tissue sample from the first subject and the amount of two or more RNA transcript splice variants in the second tissue sample from the second subject; and (d) comparing the amount of the two or more RNA transcript splice variants in the first tissue sample to the amount of the two or more RNA transcript splice variants in the second tissue sample, wherein modulation in the amount of the two or more RNA transcript splice variants in the first tissue sample relative to the amount of the two or more RNA transcript splice variants in the second tissue sample indicates that the compound of Formula (I) or a form thereof modifies the splicing of the RNA transcript. In certain aspects, a compound of Formula (I) or form thereof is administered to a subject at a dose of about 0.001 mg/kg/day to about 500 mg/kg/day. In some aspects, a single dose of a compound of Formula (I) or a form thereof is administered to a subject in accordance with the methods described herein. In other aspects, 2, 3, 4, 5 or more doses of a compound of Formula (I) is administered to a subject in accordance with the methods described herein. In specific aspects, the compound of Formula (I) or a form thereof is administered in a subject in a pharmaceutically acceptable carrier, excipient or diluent.

In some aspects, the compound of Formula (I) or a form thereof that is contacted or cultured with a cell(s) or a tissue sample, or administered to a subject is a compound described herein.

Techniques known to one skilled in the art may be used to determine the amount of an RNA transcript(s). In some aspects, the amount of one, two, three or more RNA transcripts is measured using deep sequencing, such as ILLUMINA® RNASeq, ILLUMINA® next generation sequencing (NGS), ION TORRENT® RNA next generation sequencing, 454™ pyrosequencing, or Sequencing by Oligo Ligation Detection (SOLID™), Single Molecule, Real-Time (SMRT) sequencing, Nanopore sequencing. In other aspects, the amount of multiple RNA transcripts is measured using an exon array, such as the GENECHIP® human exon array. In certain aspects, the amount of one, two, three or more RNA transcripts is determined by RT-PCR. In other aspects, the amount of one, two, three or more RNA transcripts is measured by RT-qPCR or digital color-coded barcode technology. Techniques for conducting these assays are known to one skilled in the art.

In some aspects, analysis is performed on data derived from the assay to measure the magnitude of splicing to determine the amount of exons spliced into an mRNA transcript that is produced in the presence of the compound relative to the amount in the absence of the compound or presence of a negative control. In a preferred aspect, the method utilized is calculation of change in Percent Spliced In (ΔPSI). The method utilizes read data from RNAseq (or any other method that can distinguish mRNA splice isoforms) to calculate the ratio (percentage) between reads that either demonstrate inclusion (junctions between the upstream exon and the exon of interest) or exclusion (junction between the upstream and downstream exons, excluding the exon of interest), to demonstrate whether the presence of the compound affects the amount of exon inclusion relative to the amount of inclusion in the absence of the compound or the presence of a negative control.

The ΔPSI value is derived from the formula:

$$\Delta PSI\ (\%) = C - U \times 100$$

Where "U" represents the value for probability of iExon inclusion (a+b)/2/[(a+b)/2+c] in the absence of the compound; and, where "C" represents the value for probability of iExon inclusion (a+b)/2/[(a+b)/2+c] in the presence of the compound. The values for "a" and "b" represent the number of reads supporting inclusion of an iExon in an RNA transcript. In other words, the "a" value is derived from the amount of reads for a first intronic nucleotide sequence comprising, in 5' to 3' order: a first exon 5' splice site operably linked and upstream from a first intronic nucleotide sequence comprising a first branch point further operably linked and upstream from a first intronic 3' splice site (upstream of the nascent iExon). The "b" value is derived from the amount of reads for a second intronic nucleotide sequence comprising, in 5' to 3' order: a REMS sequence operably linked and upstream from a second intronic nucleotide sequence comprising a second branch point further operably linked and upstream from a second intronic 3' splice site of a second exon. The value for "c" represents the number of reads supporting exclusion of an iExon. Accordingly, when a compound enables the splicing machinery to recognize a nascent iExon, the value for "C" in the presence of the splicing modulates compound will differ from the value for "U" in the absence of the compound. The statistically significant value for the likelihood of iExon inclusion may be obtained according to statistical analysis methods or other probability analysis methods known to those of ordinary skill in the art.

In some aspects, a statistical analysis or other probability analysis is performed on data from the assay utilized to measure an RNA transcript. In certain aspects, for example, a Fisher's Exact Test statistical analysis is performed by comparing the total number of read for the inclusion and exclusion of an iExon (or region) based on data from one or more assays used to measure whether the amount of an RNA transcript is modulated in the presence of the compound relative to the amount in the absence of the compound or presence of a negative control. In specific aspects, the statistical analysis results in a confidence value for those modulated RNA transcripts of 10%, 5%, 4%, 3%, 2%, 1%, 0.5%, 0.1%, 0.01%, 0.001% or 0.0001%. In some specific aspects, the confidence value is a p value for those modulated RNA transcripts of 10%, 5%, 4%,3%, 2%, 1%, 0.5%, 0.1%, 0.01%, 0.001% or 0.0001%. In certain specific aspects, an exact test, student t-test or p value for those modulated RNA transcripts is 10, 5%, 4%, 3%, 2%, 1%, 0.5% or 0.1% and 10%, 5%, 4%, 3%, 2%, 1%, 0.5%, 0.1%, 0.01%, 0.001% or 0.0001%, respectively.

In certain aspects, a further analysis is performed to determine how the compound of Formula (I) or a form thereof is changing the amount of an RNA transcript(s). In specific aspects, a further analysis is performed to determine if modulation in the amount of an RNA transcript(s) in the presence of a compound of Formula (I) or a form thereof relative the amount of the RNA transcript(s) in the absence of the compound or a form thereof, or the presence of a negative control is due to changes in transcription, splicing, and/or stability of the RNA transcript(s). Techniques known to one skilled in the art may be used to determine whether a compound of Formula (I) or a form thereof changes, e.g., the transcription, splicing and/or stability of an RNA transcript(s).

In certain aspects, the stability of one or more RNA transcripts is determined by serial analysis of gene expression (SAGE), differential display analysis (DD), RNA arbitrary primer (RAP)-PCR, restriction endonuclease-lytic analysis of differentially expressed sequences (READS), amplified restriction fragment-length polymorphism (ALFP), total gene expression analysis (TOGA), RT-PCR, RT-RPA (recombinase polymerase amplification), RT-qPCR, RNA-Seq, digital color-coded barcode technology, high-density cDNA filter hybridization analysis (HDFCA), suppression subtractive hybridization (SSH), differential screening (DS), cDNA arrays, oligonucleotide chips, or tissue microarrays. In other aspects, the stability of one or more RNA transcripts is determined by Northern blot, RNase protection, or slot blot.

In some aspects, the transcription in a cell(s) or tissue sample is inhibited before (e.g., 5 minutes, 10 minutes, 30 minutes, 1 hour, 2 hours, 4 hours, 6 hours, 8 hours, 12 hours, 18 hours, 24 hours, 36 hours, 48 hours, or 72 hours before) or after (e.g., 5 minutes, 10 minutes, 30 minutes, 1 hour, 2 hours, 4 hours, 6 hours, 8 hours, 12 hours, 18 hours, 24 hours, 36 hours, 48 hours, or 72 hours after) the cell or the tissue sample is contacted or cultured with an inhibitor of transcription, such as α-amanitin, DRB, flavopiridol, triptolide, or actinomycin-D. In other aspects, the transcription in a cell(s) or tissue sample is inhibited with an inhibitor of transcription, such as α-amanitin, DRB, flavopiridol, triptolide, or actinomycin-D, while the cell(s) or tissue sample is contacted or cultured with a compound of Formula (I) or a form thereof.

In certain aspects, the level of transcription of one or more RNA transcripts is determined by nuclear run-on assay or an in vitro transcription initiation and elongation assay. In some aspects, the detection of transcription is based on measuring radioactivity or fluorescence. In some aspects, a PCR-based amplification step is used.

In specific aspects, the amount of alternatively spliced forms of the RNA transcripts of a particular gene are measured to see if there is modulation in the amount of one, two or more alternatively spliced forms of the RNA transcripts of the gene. In some aspects, the amount of an isoform(s) encoded by a particular gene is measured to see if there is modulation in the amount of the isoform(s). In certain aspects, the levels of spliced forms of RNA are quantified by RT-PCR, RT-qPCR, RNA-Seq, digital color-coded barcode technology, or Northern blot. In other aspects, sequence-specific techniques may be used to detect the levels of an individual spliceoform. In certain aspects, splicing is measured in vitro using nuclear extracts. In some aspects, detection is based on measuring radioactivity or fluorescence. Techniques known to one skilled in the art may be used to measure modulation in the amount of alternatively spliced forms of an RNA transcript of a gene and modulation in the amount of an isoform encoded by a gene.

Pharmaceutical Compositions and Modes of Administration

When administered to a patient, a compound of Formula (I) or a form thereof is preferably administered as a component of a composition that optionally comprises a pharmaceutically acceptable carrier, excipient or diluent. The composition can be administered orally, or by any other convenient route, for example, by infusion or bolus injection, by absorption through epithelial or mucocutaneous linings (e.g., oral mucosa, rectal, and intestinal mucosa) and may be administered together with another biologically active agent. Administration can be systemic or local. Various delivery systems are known, e.g., encapsulation in liposomes, microparticles, microcapsules, capsules, and can be used to administer the compound.

Methods of administration include, but are not limited to, parenteral, intradermal, intramuscular, intraperitoneal, intravenous, subcutaneous, intranasal, epidural, oral, sublingual, intranasal, intraocular, intratumoral, intracerebral, intravaginal, transdermal, ocularly, rectally, by inhalation, or topically, particularly to the ears, nose, eyes, or skin. The mode of administration is left to the discretion of the practitioner. In most instances, administration will result in the release of a compound into the bloodstream, tissue or cell(s). In a specific aspect, a compound is administered orally.

The amount of a compound of Formula (I) or a form thereof that will be effective in the treatment of a disease resulting from an aberrant amount of mRNA transcripts depends, e.g., on the route of administration, the disease being treated, the general health of the subject, ethnicity, age, weight, and gender of the subject, diet, time, and the severity of disease progress, and should be decided according to the judgment of the practitioner and each patient's or subject's circumstances.

In specific aspects, an "effective amount" in the context of the administration of a compound of Formula (I) or a form thereof, or composition or medicament thereof refers to an amount of a compound of Formula (I) or a form thereof to a patient which has a therapeutic effect and/or beneficial effect. In certain specific aspects, an "effective amount" in the context of the administration of a compound of Formula (I) or a form thereof, or composition or medicament thereof to a patient results in one, two or more of the following effects: (i) reduces or ameliorates the severity of a disease; (ii) delays onset of a disease; (iii) inhibits the progression of a disease; (iv) reduces hospitalization of a subject; (v) reduces hospitalization length for a subject; (vi) increases the survival of a subject; (vii) improves the quality of life of a subject; (viii) reduces the number of symptoms associated with a disease; (ix) reduces or ameliorates the severity of a symptom(s) associated with a disease; (x) reduces the duration of a symptom associated with a disease associated; (xi) prevents the recurrence of a symptom associated with a disease; (xii) inhibits the development or onset of a symptom of a disease; and/or (xiii) inhibits of the progression of a symptom associated with a disease. In certain aspects, an effective amount of a compound of Formula (I) or a form thereof is an amount effective to restore the amount of a RNA transcript of a gene to the amount of the RNA transcript detectable in healthy patients or cells from healthy patients. In other aspects, an effective amount of a compound of Formula (I) or a form thereof is an amount effective to restore the amount an RNA isoform and/or protein isoform of gene to the amount of the RNA isoform and/or protein isoform detectable in healthy patients or cells from healthy patients.

In certain aspects, an effective amount of a compound of Formula (I) or a form thereof is an amount effective to decrease the aberrant amount of an RNA transcript of a gene which associated with a disease. In certain aspects, an effective amount of a compound of Formula (I) or a form thereof is an amount effective to decrease the amount of the aberrant expression of an isoform of a gene. In some aspects, an effective amount of a compound of Formula (I) or a form thereof is an amount effective to result in a substantial change in the amount of an RNA transcript (e.g., mRNA transcript), alternative splice variant or isoform.

In certain aspects, an effective amount of a compound of Formula (I) or a form thereof is an amount effective to increase or decrease the amount of an RNA transcript (e.g., an mRNA transcript) of gene which is beneficial for the prevention and/or treatment of a disease. In certain aspects, an effective amount of a compound of Formula (I) or a form thereof is an amount effective to increase or decrease the amount of an alternative splice variant of an RNA transcript of gene which is beneficial for the prevention and/or treatment of a disease. In certain aspects, an effective amount of a compound of Formula (I) or a form thereof is an amount effective to increase or decrease the amount of an isoform of gene which is beneficial for the prevention and/or treatment of a disease. Non-limiting examples of effective amounts of a compound of Formula (I) or a form thereof are described herein.

For example, the effective amount may be the amount required to prevent and/or treat a disease associated with the aberrant amount of an mRNA transcript of gene in a human subject.

In general, the effective amount will be in a range of from about 0.001 mg/kg/day to about 500 mg/kg/day for a patient having a weight in a range of between about 1 kg to about 200 kg. The typical adult subject is expected to have a median weight in a range of between about 70 and about 100 kg.

Within the scope of the present description, the "effective amount" of a compound of Formula (I) or a form thereof for use in the manufacture of a medicament, the preparation of a pharmaceutical kit or in a method for preventing and/or treating a disease in a human subject in need thereof, is intended to include an amount in a range of from about 0.001 mg to about 35,000 mg.

The compositions described herein are formulated for administration to the subject via any drug delivery route known in the art. Non-limiting examples include oral, ocular, rectal, buccal, topical, nasal, ophthalmic, subcutaneous, intramuscular, intravenous (bolus and infusion), intracerebral, transdermal, and pulmonary routes of administration.

Aspects described herein include the use of a compound of Formula (I) or a form thereof in a pharmaceutical composition. In a specific aspect, described herein is the use of a compound of Formula (I) or a form thereof in a pharmaceutical composition for preventing and/or treating a disease in a human subject in need thereof comprising administering an effective amount of a compound of Formula (I) or a form thereof in admixture with a pharmaceutically acceptable carrier, excipient or diluent. In a specific aspect, the human subject is a patient with a disease associated with the aberrant amount of an mRNA transcript(s).

A compound of Formula (I) or a form thereof may optionally be in the form of a composition comprising the compound or a form thereof and an optional carrier, excipient or diluent. Other aspects provided herein include pharmaceutical compositions comprising an effective amount of a compound of Formula (I) or a form thereof and a pharmaceutically acceptable carrier, excipient, or diluent. In a specific aspect, the pharmaceutical compositions are suitable for veterinary and/or human administration. The pharmaceutical compositions provided herein can be in any form that allows for the composition to be administered to a subject.

In a specific aspect and in this context, the term "pharmaceutically acceptable carrier, excipient or diluent" means a carrier, excipient or diluent approved by a regulatory agency of the Federal or a state government or listed in the U.S. Pharmacopeia or other generally recognized pharmacopeia for use in animals, and more particularly in humans. The term "carrier" refers to a diluent, adjuvant (e.g., Freund's adjuvant (complete and incomplete)), excipient, or vehicle with which a therapeutic agent is administered. Such pharmaceutical carriers can be sterile liquids, such as water and oils, including those of petroleum, animal, vegetable or synthetic origin, such as peanut oil, soybean oil, mineral oil, sesame oil and the like. Water is a specific carrier for intravenously administered pharmaceutical compositions. Saline solutions and aqueous dextrose and glycerol solutions can also be employed as liquid carriers, particularly for injectable solutions.

Typical compositions and dosage forms comprise one or more excipients. Suitable excipients are well-known to those skilled in the art of pharmacy, and non-limiting examples of suitable excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol and the like. Whether a particular excipient is suitable for incorporation into a pharmaceutical composition or dosage form depends on a variety of factors well known in the art including, but not limited to, the way in which the dosage form will be administered to a patient and the specific active ingredients in the dosage form. Further provided herein are anhydrous pharmaceutical compositions and dosage forms comprising one or more compounds of Formula (I) or a form thereof as described herein. The compositions and single unit dosage forms can take the form of solutions or syrups (optionally with a flavoring agent), suspensions (optionally with a flavoring agent), emulsions, tablets (e.g., chewable tablets), pills, capsules, granules, powder (optionally for reconstitution), taste-masked or sustained-release formulations and the like.

Pharmaceutical compositions provided herein that are suitable for oral administration can be presented as discrete dosage forms, such as, but are not limited to, tablets, caplets, capsules, granules, powder, and liquids. Such dosage forms contain predetermined amounts of active ingredients, and may be prepared by methods of pharmacy well known to those skilled in the art.

Examples of excipients that can be used in oral dosage forms provided herein include, but are not limited to, binders, fillers, disintegrants, and lubricants.

Methods of Modulating the Amount of RNA Transcripts Encoded by Certain Genes

In one aspect, described herein are methods for modifying RNA splicing in order to modulate the amount of a product of a gene, wherein a precursor RNA transcript transcribed from the gene contains an intronic REMS, and the methods utilize a compound described herein. In certain aspects, the gene is any one of the genes described herein. In certain aspects, the gene contains a nucleotide sequence encoding a non-endogenous intronic REMS. In one aspect, provided herein are methods for modifying RNA splicing in order to modulate the amount of one, two, three or more RNA transcripts of a gene described herein, the method comprising contacting a cell with a compound of Formula (I) or a form thereof.

In another aspect, provided herein is a method for modifying RNA splicing in order to modulate the amount of a product of a gene (such as an RNA transcript or a protein), wherein the gene comprises a DNA nucleotide sequence encoding two exons and an intron, wherein the nucleotide sequence encoding a first exon is upstream of the nucleotide sequence encoding the intron and the nucleotide sequence encoding a second exon is downstream of the nucleotide sequence encoding the intron, wherein the DNA nucleotide sequence encoding the intron comprises in 5' to 3' order: a nucleotide sequence encoding a first 5' splice site, a nucleotide sequence encoding a first branch point, a nucleotide sequence encoding a first 3' splice site, a nucleotide sequence encoding an iREMS, a nucleotide sequence encoding a second branch point and a nucleotide sequence encoding a second 3' splice site, wherein the nucleotide sequence encoding the iREMS comprises a DNA sequence GAgtrngn, and wherein r is adenine or guanine and n is any nucleotide, the method comprising contacting a cell with a compound described herein (for example, a compound of Formula (I) or a form thereof).

In another aspect, provided herein is a method for modifying RNA splicing in order to modulate the amount of a product of a gene (such as an RNA transcript or protein), wherein the gene comprises a DNA nucleotide sequence encoding two exons and an intron, wherein the nucleotide sequence encoding a first exon is upstream of the nucleotide sequence encoding the intron and the nucleotide sequence encoding a second exon is downstream of the nucleotide sequence encoding the intron, wherein the DNA nucleotide sequence of the intron comprises in 5' to 3' order: a nucleotide sequence encoding an iREMS, a nucleotide sequence encoding a branch point and a nucleotide sequence encoding a 3' splice site, wherein the nucleotide sequence encoding the iREMS comprises a DNA sequence GAgtrngn, and wherein r is adenine or guanine and n is any nucleotide, the method comprising contacting a cell with a compound described herein (for example, a compound of Formula (I) or a form thereof).

In another aspect, provided herein is a method for modifying RNA splicing in order to modulate the amount of a product of a gene (such as an RNA transcript or protein), wherein the gene comprises a DNA nucleotide sequence encoding two exons and an intron, and wherein the DNA nucleotide sequence encodes exonic and intronic elements illustrated in FIG. 1A, the method comprising contacting a cell with a compound described herein.

In another aspect, provided herein is a method for modifying RNA splicing in order to modulate the amount of a product of a gene (such as an RNA transcript or protein), wherein the gene comprises a DNA nucleotide sequence encoding two exons and an intron, and wherein the DNA nucleotide sequence encodes exonic and intronic elements illustrated in FIG. 1B, the method comprising contacting a cell with a compound described herein.

In another aspect, provided herein is a method for modifying RNA splicing in order to modulate the amount of a product of a gene (such as an RNA transcript or protein), wherein the gene comprises a DNA nucleotide sequence encoding two exons and an intron, and wherein the DNA nucleotide sequence encodes exonic and intronic elements illustrated in FIG. 1C, the method comprising contacting a cell with a compound described herein.

In a specific aspect, the gene is a gene described in a table in this disclosure.

In another aspect, provided herein are methods for modifying RNA splicing in order to modulate the amount of one, two, three or more RNA transcripts of a gene described herein, wherein the precursor transcript transcribed from the gene comprises an intronic REMS, the method comprising contacting a cell with a compound of Formula (I) or a form thereof. In a specific aspect, the precursor transcript contains in 5' to 3' order: a branch point, a 3' splice site and an intronic REMS. In another specific aspect, the precursor transcript contains in 5' to 3' order: a first 5' splice site, a first branch point, a first 3' splice site, an intronic REMS, a second branch point, and a second 3' splice site. In another specific aspect the precursor transcript contains in 5' to 3' order: an intronic REMS, a branch point, and a 3' splice site.

In another aspect, provided herein are methods for modifying RNA splicing in order to modulate the amount of one, two, three or more RNA transcripts of a gene described herein, wherein the precursor transcript transcribed from the gene comprises an intronic REMS, the method comprising contacting a cell with a compound of Formula (I) or a form thereof. In a specific aspect, the precursor transcript contains in 5' to 3' order: a branch point, a 3' splice site and an intronic REMS. In another specific aspect, the precursor transcript contains in 5' to 3' order: a first 5' splice site, a first branch point, a first 3' splice site, an intronic REMS, a second branch point, and a second 3' splice site. In another specific aspect the precursor transcript contains in 5' to 3' order: an intronic REMS, a branch point, and a 3' splice site.

In another aspect, provided herein are methods for modifying RNA splicing in order to modulate the amount of one, two, three or more RNA transcripts of a gene described herein, comprising contacting a cell with a compound of Formula (I) or a form thereof. See the example section for additional information regarding the genes described herein. In certain aspects, the cell is contacted with the compound of Formula (I) or a form thereof in a cell culture. In other aspects, the cell is contacted with the compound of Formula (I) or a form thereof in a subject (e.g., a non-human animal subject or a human subject).

In one aspect, provided herein is a method for modifying RNA splicing in order to produce a mature mRNA transcript having an iExon from a pre-mRNA transcript, wherein the pre-mRNA transcript comprises two exons and an intron, wherein a first exon is upstream of the intron and a second exon is downstream of the intron, wherein the intron comprises in 5' to 3' order: a first 5' splice site, a first branch point, a first 3' splice site, an endogenous or non-endogenous intronic recognition element for splicing modifier (iREMS), a second branch point, and a second 3' splice site, wherein the iREMS comprises an RNA sequence GAgurngn, wherein r is adenine or guanine and n is any nucleotide.

In one aspect, provided herein is a method for modifying RNA splicing in order to produce a mature mRNA transcript having an iExon, the method comprising contacting a pre-mRNA transcript with a compound of Formula (I) or a form thereof, wherein the pre-mRNA transcript comprises two exons and an intron, wherein a first exon is upstream of the intron and a second exon is downstream of the intron, wherein the intron comprises in 5' to 3' order: a first 5' splice site, a first branch point, a first 3' splice site, an endogenous or non-endogenous intronic recognition element for splicing modifier (iREMS), a second branch point, and a second 3' splice site, wherein the iREMS comprises an RNA sequence GAgurngn, wherein r is adenine or guanine and n is any nucleotide.

In another aspect, provided herein is a method for modifying RNA splicing in order to produce a mature mRNA transcript having an iExon, the method comprising contacting a cell or cell lysate containing a pre-mRNA transcript with a compound of Formula (I) or a form thereof, wherein the pre-mRNA transcript comprises two exons and an intron, wherein a first exon is upstream of the intron and a second exon is downstream of the intron, wherein the intron comprises in 5' to 3' order: a first 5' splice site, a first branch point, a first 3' splice site, an endogenous or non-endogenous intronic recognition element for splicing modifier (iREMS), a second branch point, and a second 3' splice site, wherein the iREMS comprises an RNA sequence GAgurngn, wherein r is adenine or guanine and n is any nucleotide. In some aspects, the pre-mRNA transcript is encoded by a gene disclosed herein (e.g., in a table herein).

In a particular aspect, provided herein is a method for modifying RNA splicing in order to produce a mature mRNA transcript having an iExon, the method comprising contacting a pre-mRNA transcript with a compound of Formula (I) or a form thereof, wherein the pre-mRNA transcript comprises two exons and an intron, wherein a first exon is upstream of the intron and a second exon is downstream of the intron, wherein the intron comprises in 5' to 3' order: a first 5' splice site, a first branch point, a first 3' splice site, an endogenous or non-endogenous intronic recognition element for splicing modifier (iREMS), a second branch point, and a second 3' splice site, wherein the iREMS comprises an RNA sequence GAgurngn, wherein r is adenine or guanine and n is any nucleotide, and wherein the pre-mRNA transcript is a pre-mRNA transcript of a gene that is selected from ABCB8, ABCC3, ADAM17, ADCY3, AGPAT4, ANKRA2, ANXA11, APIP, APPL2, ARHGAP1, ARL15, ASAP1, ASPH, ATAD2B, ATXN1, BECN1, BHMT2, BICD1, BTN3A1, C11orf30, C11orf73, C12orf4, C14orfI32, C8orf44, C8orf44-SGK3, C8orf88, CASC3, CASP7, CCDC122, CDH13, CECR7, CENPI, CEP112, CEP192, CHEK1, CMAHP, CNRIP1, COPS7B, CPSF4, CRISPLD2, CRYBG3, CSNK1E, CSNK1G1, DCAF17, DCUN1D4, DDX42, DENND1A, DENND5A, DGKA, DHFR, DIAPH3, DNAJC13, DNMBP, DOCK1, DYRK1A, EIF2B3, ENAH, ENOX1, EP300, ERC1, ERLIN2, ERRFI1, EVC, FAF1, FAIM, FAM126A, FAM13A, FAM162A, FAM174A, FBN2, FER, FHOD3, FOCAD, GALC, GCFC2, GGACT, GLCE, GOLGA4, GOLGB1, GPSM2, GULP1, GXYLT1, HDX, HLTF, HMGA2, HNMT, HSD17B12, HSD17B4, HTT, IFT57, IVD, KDM6A, KIAA1524, KIAA1715, LETM2, LOC400927, LRRC42, LUC7L3, LYRM1, MB21D2, MCM10, MED13L, MEDAG, MEMO1, MFN2, MMS19, MRPL45, MRPS28, MTERF3, MYCBP2, MYLK, MYOF, NGF, NREP, NSUN4, NT5C2, OSMR, OXCT1, PAPD4, PCM1, PDE7A, PDS5B, PDXDC1, PIGN, PIK3CD, PIK3R1, PIKFYVE, PITPNB, PLEKHA1, PLSCR1, PMS1, POMT2, PPARG, PPIP5K2, PPP1R26, PRPF31, PRSS23, PSMA4, PXK, RAF1, RAPGEF1, RARS2, RBKS, RERE, RFWD2, RPA1, RPS10, SAMD4A, SAR1A, SCO1, SEC24A, SENP6, SERGEF, SGK3, SLC12A2, SLC25A17, SLC44A2, SMYD3, SNAP23, SNHG16, SNX7, SOS2, SPATA5, SPIDR, SPRYD7, SRGAP1, SRRM1, STAT1, STXBP6, SUPT20H, TAF2, TASP1, TBC1D15, TCF12, TCF4, TIAM1, TJP2, TMC3, TMEM214, TNRC6A, TNS3, TOE1, TRAF3, TSPAN2, TTC7B, TYW5, UBAP2L, URGCP, VAV2, WDR27, WDR37, WDR91, WNK1, XRN2, ZCCHC8, ZFP82, ZNF138, ZNF232 and ZNF37BP.

In another particular aspect, provided herein is a method for modifying RNA splicing in order to produce a mature mRNA transcript having an iExon, the method comprising contacting a cell or cell lysate containing a pre-mRNA transcript with a compound of Formula (I) or a form thereof, wherein the pre-mRNA transcript comprises two exons and an intron, wherein a first exon is upstream of the intron and a second exon is downstream of the intron, wherein the intron comprises in 5' to 3' order: a first 5' splice site, a first branch point, a first 3' splice site, an endogenous or non-endogenous intronic recognition element for splicing modifier (iREMS), a second branch point, and a second 3' splice site, wherein the iREMS comprises an RNA sequence GAgurngn, wherein r is adenine or guanine and n is any nucleotide, and wherein the pre-mRNA transcript is a pre-mRNA transcript of a gene that is selected from ABCB8, ABCC3, ADAM17, ADCY3, AGPAT4, ANKRA2, ANXA11, APIP, APPL2, ARHGAP1, ARL15, ASAP1, ASPH, ATAD2B, ATXN1, BECN1, BHMT2, BICD1, BTN3A1, C11orf30, C11orf73, C12orf4, C14orfI32, C8orf44, C8orf44-SGK3, C8orf88, CASC3, CASP7, CCDC122, CDH13, CECR7, CENPI, CEP112, CEP192, CHEK1, CMAHP, CNRIP1, COPS7B, CPSF4, CRISPLD2, CRYBG3, CSNK1E, CSNK1G1, DCAF17, DCUN1D4, DDX42, DENND1A, DENND5A, DGKA, DHFR, DIAPH3, DNAJC13, DNMBP, DOCK1, DYRK1A, EIF2B3, ENAH, ENOX1, EP300, ERC1, ERLIN2, ERRFI1, EVC, FAF1, FAIM, FAM126A, FAM13A, FAM162A, FAM174A, FBN2, FER, FHOD3, FOCAD, GALC, GCFC2, GGACT, GLCE, GOLGA4, GOLGB1, GPSM2, GULP1, GXYLT1, HDX, HLTF, HMGA2, HNMT, HSD17B12, HSD17B4, HTT, IFT57, IVD, KDM6A, KIAA1524, KIAA1715, LETM2, LOC400927, LRRC42, LUC7L3, LYRM1, MB21D2, MCM10, MED13L, MEDAG, MEMO1, MFN2, MMS19, MRPL45, MRPS28, MTERF3, MYCBP2, MYLK, MYOF, NGF, NREP, NSUN4, NT5C2, OSMR, OXCT1, PAPD4, PCM1, PDE7A, PDS5B, PDXDC1, PIGN, PIK3CD, PIK3R1, PIKFYVE, PITPNB, PLEKHA1, PLSCR1, PMS1, POMT2, PPARG, PPIP5K2, PPP1R26, PRPF31, PRSS23, PSMA4, PXK, RAF1, RAPGEF1, RARS2, RBKS, RERE, RFWD2, RPA1, RPS10, SAMD4A, SAR1A, SCO1, SEC24A, SENP6, SERGEF, SGK3, SLC12A2, SLC25A17, SLC44A2, SMYD3, SNAP23, SNHG16, SNX7, SOS2, SPATA5, SPIDR, SPRYD7, SRGAP1, SRRM1, STAT1, STXBP6, SUPT20H, TAF2, TASP1, TBC1D15, TCF12, TCF4, TIAM1, TJP2, TMC3, TMEM214, TNRC6A, TNS3, TOE1, TRAF3, TSPAN2, TTC7B, TYW5, UBAP2L, URGCP, VAV2, WDR27, WDR37, WDR91, WNK1, XRN2, ZCCHC8, ZFP82, ZNF138, ZNF232 and ZNF37BP.

In another particular aspect, provided herein is a method for modifying RNA splicing in order to produce a mature mRNA transcript having an iExon, the method comprising contacting a cell or cell lysate containing a pre-mRNA transcript with a compound of Formula (I) or a form thereof, wherein the pre-mRNA transcript comprises two exons and an intron, wherein a first exon is upstream of the intron and a second exon is downstream of the intron, wherein the intron comprises in 5' to 3' order: a first 5' splice site, a first branch point, a first 3' splice site, an endogenous or non-endogenous intronic recognition element for splicing modifier (iREMS), a second branch point, and a second 3' splice site, wherein the iREMS comprises an RNA sequence GAgurngn, wherein r is adenine or guanine and n is any nucleotide, and wherein the pre-mRNA transcript is a pre-mRNA transcript of a gene that is selected from ABCA1, ABCA10, ABCB7, ABCB8, ABCC1, ABCC3, ABHD10, ABL2, ABLIM3, ACACA, ACADVL, ACAT2, ACTA2, ADAL, ADAM12, ADAM15, ADAM17, ADAM23, ADAM33, ADAMTS1, ADAMTS19, ADCY3, ADD1, ADGRG6, ADH6, ADHFE1, AFF2, AFF3, AGK, AGPAT3, AGPAT4, AGPS, AHCYL2, AHDC1, AHRR, AJUBA, AK021888, AK310472, AKAP1, AKAP3, AKAP8L, AKAP9, AKNA, AKT1, ALCAM, ALDH4A1, AMPD2, ANK1, ANK2, ANK3, ANKFY1, ANKHD1-EIF4EBP3, ANKRA2, ANKRD13C, ANKRD17, ANKRD33B, ANKRD36, ANKS6, ANP32A, ANXA11, ANXA6, AP2B1, AP4B1-AS1, APAF1, APIP, APLP2, APOA2, APP, APPL2, APTX, ARHGAP1, ARHGAP12, ARHGAP22, ARHGAP5, ARHGEF16, ARID1A, ARID2, ARID5B, ARL9, ARL15, ARL5B, ARMCX3, ARMCX6, ARSJ, ASAP1, ASIC1, ASL, ASNS, ASPH, ATAD2B, ATF6, ATF7IP, ATG5, ATG9A, ATMIN, ATP2A3, ATP2C1, ATXN1, ATXN3, AURKA, AXIN1, B3GALT2, B3GNT6, B4GALT2, BACE1, BAG2, BASP1, BC033281, BCAR3, BCL2L15, BCYRN1, BECN1, BEND6, BHMT2, BICD1, BIN1, BIN3, BIN3-IT1, BIRC3, BIRC6, BNC1, BNC2, BRCA1, BRCA2, BRD2, BRPF1, BSCL2, BTBD10, BTG2, BTN3A1, BZW1, C1QTNF9B-AS1, C1orf27, C1orf86, C10orf54, C11orf30, C11orf70, C11orf73, C11orf76, C11orf94, C12orf4, C12orf56, C14orf132, C17orf76-AS1, C19orf47, C2orf47, C3, C4orf27, C5orf24, C6orf48, C7orf31, C8orf34, C8orf44, C8orf44-SGK3, C8orf88, C9orf69, CA13, CA3, CAB39, CACNA2D2, CACNB1, CACNB4, CADM1, CADM2, CALU, CAMKK1, CAND2, CAPNS1, CASC3, CASP7, CASP8AP2, CAV1, CCAR1, CCDC77, CCDC79, CCDC88A, CCDC92, CCDC122, CCER2, CCNF, CCNL2, CCT6A, CD276, CD46, CDC25B, CDC40, CDC42BPA, CDCA7, CDH11, CDH13, CDH18, CDK11B, CDK16, CDKAL1, CDKN1C, CECR7, CELSR1, CEMIP, CENPI, CEP112, CEP162, CEP170, CEP192, CEP57, CEP68, CFH, CFLAR, CHD8, CHEK1, CHRM2, CIITA, CIZ1, CLDN23, CLIC1, CLK4, CLTA, CMAHP, CNGA4, CNOT1, CNRIP1, CNTD1, CMSS1, CNOT7, CNRIP1, CNTN1, COG1, COL1A1, COL11A1, COL12A1, COL14A1, COL15A1, COL5A1, COL5A3, COL6A1, COL6A6, COL8A1, COLEC12, COMP, COPS7B, CPA4, CPEB2, CPQ, CPSF4, CREB5, CRISPLD2, CRLF1, CRLS1, CRTAP, CRX, CRYBG3, CRYL1, CSDE1, CSNK1A1, CSNK1E, CSNK1G1, CTDSP2, CTNND1, CTRC, CUL2, CUL4A, CUX1, CYB5B, CYB5R2, CYBRD1, CYGB, CYP1B1, CYP51A1, DAAM1, DAB2, DACT1, DAGLB, DARS, DAXX, DCAF10, DCAF11, DCAF17, DCBLD2, DCLK1, DCN, DCUN1D4, DDAH1, DDAH2, DDHD2, DDIT4L, DDR1, DDX39B, DDX42, DDX50, DEGS1, DENND1A, DENND1B, DENND4A, DENND5A, DEPTOR, DET1, DFNB59, DGCR2, DGK1, DGKA, DHCR24, DHCR7, DHFR, DHX9, DIAPH1, DIAPH3, DIRAS3, DIS3L, DKFZp434M1735, DKK3, DLC1, DLG5, DLGAP4, DMD, DMXL1, DNAH8, DNAH11, DNAJA4, DNAJC13, DNAJC27, DNM2, DNMBP, DOCK1, DOCK11, DPP8, DSEL, DST, DSTN, DYNC1I1, DYRK1A, DZIP1L, EBF1, EEA1, EEFIA1, EFCAB14, EFEMP1, EGR1, EGR3, EHMT2, EIF2B3, EIF4G1, EIF4G2, EIF4G3, ELF2, ELMO2, ELN, ELP4, EMX2OS, ENAH, ENG, ENOX1, ENPP1, ENPP2, ENSA, EP300, EPN1, EPT1, ERC1, ERC2, ERCC1, ERCC8, ERGIC3, ERLIN2, ERRFI1, ESM1, ETV5, EVC, EVC2, EXO1, EXOC3, EXOC6B, EXTL2, EYA3, F2R, FADS1, FADS2, FAF1, FAIM, FAM111A, FAM126A, FAM13A, FAM160A1, FAM162A, FAM174A, FAM195B, FAM198B, FAM20A, FAM208B, FAM219A, FAM219B, FAM3C, FAM46B, FAM49B, FAM65A, FAM65B, FAM69B, FAP, FARP1, FBLN2, FBN2, FBXL16, FBXL6, FBXO9, FBXO10, FBXO18, FBXO31, FBXO34, FBXO9, FCHO1, FDFT1, FDPS, FER, FEZ1, FGD4, FGD5-AS1, FGFR2, FGFRL1, FGL2, FHOD3, FLII, FLNB, FLT1, FN1, FNBP1, FOCAD, FOS, FOSB, FOSL1, FOXK1, FOXM1, FRAS1, FSCN2, FUS, FYN, GABPB1, GAL3ST4, GALC, GALNT1, GALNT15, GAS7, GATA6, GBA2, GBGT1, GBP1, GCFC2, GLCE, GCNT1, GDF6, GGACT, GGCT, GHDC, GIGYF2, GJC1, GLCE, GMIP, GNA13, GNAQ, GNAS, GNG12, GNL3L, GOLGA2, GOLGA4, GOLGB1, GORASP1, GPR1, GPR183, GPR50, GPR89A, GPRC5A, GPRC5B, GPSM2, GREM1, GRK6, GRTP1, GSE1, GTF2H2B, GTSF1, GUCA1B, GULP1, GXYLT1, HAPLN1, HAPLN2, HAS2, HAS3, HAT1, HAUS3, HAUS6, HAVCR2, HDAC5, HDAC7, HDX, HECTD2-AS1, HEG1, HEPH, HEY1, HLA-A, HLA-E, HLTF, HMGA1, HMGA2, HMGB1, HMGCR, HMGN3-AS1, HMGCS1, HMGXB4, HOOK3, HOXB3, HMOX1, HNMT, HNRNPR, HNRNPUL1, HP1BP3, HPS1, HRH1, HSD17B12, HSD17B4, HSPA1L, HTATIP2, HTT, IARS, IDH1, IDI1, IFT57, IGDCC4, IGF2BP2, IGF2R, IGFBP3, IKBKAP, IL16, IL6ST, INA, INHBA, INO80, IPP4B, INPP5K, INSIG1, INTU, INVS, IQCE, IQCG, ITCH, ITGA11, ITGA8, ITGAV, ITGB5, ITGB8, ITIH1, ITM2C, ITPKA, ITSN1, IVD, KANSL3, KAT6B, KCNK2, KCNS1, KCNS2, KDM6A, KDSR, KIAA1033, KIAA1143, KIAA1199, KIAA1456, KIAA1462, KIAA1522, KIAA1524, KIAA1549, KIAA1715, KIAA1755, KIDINS220, KIF14, KIF2A, KIF21A, KIF3A, KIT, KLC1, KLC2, KLF17, KLF6, KLHL7, KLRG1, KMT2D, KRT7, KRT18, KRT19, KRT34, KRTAP1-1, KRTAP1-5, KRTAP2-3, L3MBTL2, LAMA2, LAMB1, LAMB2P1, LARP4, LARP7, LATS2, LDLR, LEMD3, LETM2, LGALS3, LGALS8, LGI2, LGR4, LHX9, LIMS1, LINC00341, LINC00472, LINC00570, LINC00578, LINC00607, LINC00657, LINC00678, LINC00702, LINC00886, LINC00961, LINC01011, LINC01118, LINC01204, LINCR-0002, LINGO2, LMAN2L, LMNA, LMO7, LMOD1, LOC400927, LONP1, LOX, LPHN1, LRBA, LRCH4, LRIG1, LRP4, LRP8, LRRC1, LRRC32, LRRC39, LRRC42, LRRC8A, LSAMP, LSS, LTBR, LUC7L2, LUM, LYPD1, LYRM1, LZTS2, MACROD2, MADD, MAFB, MAGED4, MAGED4B, MAMDC2, MAN1A2, MAN2A1, MAN2C1, MANEA, MAP4K4, MAPK10, MAPK13, MARCH7, MARCH8, MASP1, MB, MB21D2, MBD1, MBOAT7, MC4R, MCM10, MDM2, MDN1, MEAF6, MECP2, MED1, MED13L, MEDAG, MEF2D, MEGF6, MEIS2, MEMO1, MEPCE, MFGE8, MFN2, MIAT, MICAL2, MINPP1, MIR612, MKL1, MKLN1, MKNK2, MLLT4, MLLT10, MLST8, MMAB, MMP10, MMP24, MMS19, MMS22L, MN1, MORF4L1, MOXD1, MPPE1, MPZL1, MRPL3, MRPL39, MRPL45, MRPL55, MRPS28, MRVI1, MSANTD3, MSC, MSH2, MSH4, MSH6, MSL3, MSMO1, MSRB3, MTAP, MTERF3, MTERFD1, MTHFD1L, MTMR3, MTMR9, MTRR, MUM1, MVD, MVK, MXRA5, MYADM, MYB, MYCBP2, MYLK, MYO1D, MYO9B, MYOF, NA, NAA35, NAALADL2, NADK, NAE1, NAGS, NASP, NAV1, NAV2, NCOA1, NCOA3, NCOA4, NCSTN, NDNF, NEDD4, NELFA, NEO1, NEURL1B, NF2, NFASC, NFE2L1, NFX1, NGF, NGFR, NHLH1, NID1, NID2, NIPA1, NKX3-1, NLGN1, NLN, NOL10, NOMO3, NOTCH3, NOTUM, NOVA2, NOX4, NPEPPS, NRD1, NREP, NRG1, NRROS, NSUN4, NT5C2, NT5E, NTNG1, NUDT4, NUP153, NUP35, NUP50, NUPL1, NUSAP1, OCLN, ODF2, OLR1, OS9, OSBPL3, OSBPL6, OSBPL10, OSMR, OXCT1, OXCT2, P4HA1, P4HB, PABPC1, PAIP2B, PAK4, PAPD4, PARD3, PARN, PARP14, PARP4, PARVB, PAX6, PBLD, PBX3, PCBP2, PCBP4, PCCB, PCDH10, PCDHGB3, PCGF3, PCM1, PCMTD2, PCNXL2, PCSK9, PDE1C, PDE3A, PDE4A, PDE5A, PDE7A, PDGFD, PDGFRB, PDLIM7, PDS5B, PDXDC1, PDXDC2P, PEAR1, PELI1, PEPD, PEX5, PFKP, PHACTR3, PHF19, PHF8, PHRF1, PHTF2, PI4K2A, PIEZO1, PIGN, PIGU, PIK3C2B, PIK3CD, PIK3R1, PIKFYVE, PIM2, PITPNA, PITPNB, PITPNM1, PITPNM3, PLAU, PLEC, PLEK2, PLEKHA1, PLEKHA6, PLEKHB2, PLEKHH2, PLSCR1, PLSCR3, PLXNB2, PLXNC1, PMS1, PNISR, PODN, POLE3, POLN, POLR1A, POLR3D, POMT2, POSTN, POU2F1, PPAPDC1A, PPARA, PPARG, PPFIBP1, PPHLN1, PPIP5K1, PPIP5K2, PPM1E, PPPIR12A, PPPR26, PPP3CA, PPP6R1, PPP6R2, PRKACB, PRKCA, PRKDC, PRKG1, PRMT1, PRNP, PRPF31, PRPH2, PRRG4, PRSS23, PRUNE2, PSMA4, PSMC1, PSMD6, PSMD6-AS2, PTCH1, PTGIS, PTK2B, PTPN14, PTX3, PUF60, PUS7, PVR, PXK, PXN, QKI, RAB23, RAB2B, RAB30, RAB34, RAB38, RAB44, RAD1, RAD9B, RAD23B, RAF1, RALB, RAP1A, RAP1GDS1, RAPGEF1, RARG, RARS, RARS2, RASIP1, RASSF8, RBBP8, RBCK1, RCOR3, RBFOX2, RBKS, RBM10, RCC1, RDX, RERE, RFTN1, RFWD2, RFX3-AS1, RGCC, RGL1, RGS10, RGS3, RIF1, RNF14, RNF19A, RNF130, RNF144A, RNF213, RNF38, RNFT1, ROR1, ROR2, RPA1, RPF2, RPL10, RPS10, RPS6KB2, RPS6KC1, RRBP1, RWDD4, SAMD4A, SAMD9, SAMD9L, SAR1A, SART3, SCAF4, SCAF8, SCARNA9, SCD, SCLT1, SCO1, SDCBP, SEC14L1, SEC22A, SEC24A, SEC24B, SEC61A1, SENP6, SEPT9, SERGEF, SERPINE2, SF1, SF3B3, SGIP1, SGK3, SGMS1, SGOL2, SGPL1, SH2B3, SH3RF1, SH3YL1, SHROOM3, SIGLEC10, SKA2, SKIL, SKP1, SLC12A2, SLC24A3, SLC25A16, SLC25A17, SLC34A3, SLC35F3, SLC39A3, SLC39A10, SLC4A4, SLC4A11, SLC41A1, SLC44A2, SLC46A2, SLC6A15, SLC7A6, SLC7A8, SLC7A11, SLC9A3, SLIT3, SMARCA4, SMARCC2, SMC4, SMC6, SMCHD1, SMG1, SMG1P3, SMN2, SMOX, SMPD4, SMTN, SMYD3, SMYD5, SNAP23, SNED1, SNHG16, SNX7, SNX14, SNX24, SNX7, SOCS2, SOCS6, SOGA2, SON, SORBS2, SORCS1, SORCS2, SOS2, SOX7, SPATA18, SPATA20, SPATA5, SPATS2, SPDYA, SPEF2, SPG20, SPIDR, SPINK5, SPRED2, SPRYD7, SQLE, SQRDL, SQSTM1, SRCAP, SREBF1, SREK1, SRGAP1, SRRM1, SRSF3, SSBP1, STAC2, STARD4, STAT1, STAT3, STAT4, STAU1, STC2, STEAP2, STK32B, STRAD8, STRIP1, STRN3, STRN4, STS, STX16, STXBP4, STXBP6, SULF1, SUPT20H, SVEP1, SYNE1, SYNE2, SYNGR2, SYNPO, SYNPO2, SYNPO2L, SYT15, SYTL2, TACC1, TAF2, TAGLN3, TANC2, TANGO6, TARBP1, TARS, TASP1, TBC1D15, TBCA, TBL1XR1, TBL2, TCF12, TCF4, TCF7L2, TEKT4P2, TENC1, TENM2, TEP1, TET1, TET3, TEX21P, TFCP2, TGFA, TGFB2, TGFB3, TGFB1, TGFBR1, TGFBRAP1, TGM2, THADA, THAP4, THBS2, THRB, TIAM1, TIMP2, TJAP1, TJP2, TLE3, TLK1, TMC3, TMEM67, TMEM102, TMEM119, TMEM134, TMEM154, TMEM189-UBE2V1, TMEM214, TMEM256-PLSCR3, TMEM47, TMEM50B, TMEM63A, TMX3, TNC, TNFAIP3, TNFAIP8L3, TNFRSF12A, TNFRSF14, TNIP1, TNKS1BP1, TNPO3, TNRC18P1, TNRC6A, TNS1, TNS3, TNXB, TOE1, TOMM40, TOMM5, TOPORS, TP53AIP1, TP531NP1, TPRG1, TRAF3, TRAK1, TRAPPC12, TRIB1, TRIM2, TRIM23, TRIM26, TRIM28, TRIM65, TRIM66, TRMT1L, TRPC4, TRPS1, TSC2, TSHZ1, TSHZ2, TSPAN11, TSPAN18, TSPAN2, TSPAN7, TSSK3, TTC7A, TTC7B, TUBB2C, TUBB3, TUBE1, TXNIP, TXNL1, TXNL4B, TXNRD1, TYW5, U2SURP, UBAP2L, UBE2D3, UBE2G2, UBE2L3, UBE2V1, UBN2, UBQLN4, UCHL5, UHMK1, UHRF1BP1L, UNC3B, UNC5B, URGCP, URGCP-MRPS24, USP19, USP7, USP27X, UVRAG, VANGL1, VARS2, VAV2, VCL, VDAC2, VIM-AS1, VIPAS39, VPS13A, VPS29, VPS41, VPS51, VSTM2L, VWA8, VWF, WDR19, WDR27, WDR37, WDR48, WDR90, WDR91, WHSC2, WIPF1, WISP1, WNK1, WNT5B, WNT10B, WSB1, WWTR1, XDH, XIAP, XRN2, YAP1, YDJC, YES1, YPEL5, YTHDF3, Z24749, ZAK, ZBTB10, ZBTB24, ZBTB26, ZBTB7A, ZC3H12C, ZC3H14, ZC3H18, ZCCHC5, ZCCHC8, ZCCHC11, ZEB1, ZEB2, ZFAND1, ZFAND5, ZFP82, ZHX3, ZMIZ1, ZMIZ1-AS1, ZMIZ2, ZMYM2, ZNF12, ZNF138, ZNF148, ZNF208, ZNF212, ZNF219, ZNF227, ZNF232, ZNF24, ZNF268, ZNF28, ZNF280D, ZNF281, ZNF335, ZNF350, ZNF37A, ZNF37BP, ZNF395, ZNF426, ZNF431, ZNF583, ZNF618, ZNF621, ZNF652, ZNF655, ZNF660, ZNF674, ZNF680, ZNF730, ZNF74, ZNF764, ZNF777, ZNF778, ZNF780A, ZNF7804A, ZNF79, ZNF827, ZNF836, ZNF837, ZNF839, ZNF91 and ZSCAN25.

In another particular aspect, provided herein is a method for modifying RNA splicing in order to produce a mature mRNA transcript having an iExon, the method comprising contacting a cell or cell lysate containing a pre-mRNA transcript with a compound of Formula (I) or a form thereof, wherein the pre-mRNA transcript comprises two exons and an intron, wherein a first exon is upstream of the intron and a second exon is downstream of the intron, wherein the intron comprises in 5' to 3' order: a first 5' splice site, a first branch point, a first 3' splice site, an endogenous or non-endogenous intronic recognition element for splicing modifier (iREMS), a second branch point, and a second 3' splice site, wherein the iREMS comprises an RNA sequence GAgurngn, wherein r is adenine or guanine and n is any nucleotide, and wherein the pre-mRNA transcript is a pre-mRNA transcript of a gene that is selected from APOA2, ASAP1, BRCA1, BRCA2, CDKN1C, CRX, CTRC, DENND5A, DIAPH3, DMD, DNAH11, EIF2B3, GALC, HPS1, HTT, IKBKAP, KIAA1524, LMNA, MECP2, PAPD4, PAX6, PCCB, PITPNB, PTCH1, SLC34A3, SMN2, SPINK5, SREK1, TMEM67, VWF, XDH and XRN2.

In another particular aspect, provided herein is a method for modifying RNA splicing in order to produce a mature mRNA transcript having an iExon, the method comprising contacting a cell or cell lysate containing a pre-mRNA transcript with a compound of Formula (I) or a form thereof, wherein the pre-mRNA transcript comprises two exons and an intron, wherein a first exon is upstream of the intron and a second exon is downstream of the intron, wherein the intron comprises in 5' to 3' order: a first 5' splice site, a first branch point, a first 3' splice site, an endogenous or non-endogenous intronic recognition element for splicing modifier (iREMS), a second branch point, and a second 3' splice site, wherein the iREMS comprises an RNA sequence GAgurngn, wherein r is adenine or guanine and n is any nucleotide, and wherein the pre-mRNA transcript is a pre-mRNA transcript of a gene that is selected from ABCA1, ABCA10, ABCB7, ABCB8, ABCC1, ABCC3, ABL2, ABLIM3, ACACA, ACADVL, ACAT2, ACTA2, ADAL, ADAM15, ADAM17, ADAM23, ADAM33, ADAMTS1, ADAMTS19, ADCY3, ADD1, ADGRG6, ADH6, ADHFE1, AFF2, AFF3, AGK, AGPAT3, AGPAT4, AGPS, AHCYL2, AHDC1, AHRR, AJUBA, AK021888, AK310472, AKAP1, AKAP3, AKAP8L, AKAP9, AKNA, ALCAM, ALDH4A, AMPD2, ANK1, ANK2, ANK3, ANKFY1, ANKHD1-EIF4EBP3, ANKRA2, ANKRD13C, ANKRD17, ANKRD33B, ANKRD36, ANKS6, ANP32A, ANXA6, AP2B1, AP4B1-AS1, APAF1, APIP, APOA2, APP, APTX, ARHGAP1, ARHGAP12, ARHGAP22, ARHGAP5, ARHGEF16, ARID1A, ARID2, ARID5B, ARL9, ARL15, ARL5B, ARMCX3, ARSJ, ASAP1, ASIC1, ASL, ASNS, ASPH, ATAD2B, ATF6, ATF7IP, ATG9A, ATMIN, ATP2A3, ATP2C1, ATXN1, ATXN3, AURKA, B3GALT2, B3GNT6, B4GALT2, BACE1, BAG2, BASP1, BC033281, BCAR3, BCL2L15, BCYRN1, BECN1, BEND6, BHMT2, BICD1, BIN1, BIN3, BIN3-IT1, BIRC3, BIRC6, BNC1, BNC2, BRCA1, BRCA2, BRD2, BRPF1, BSCL2, BTBD10, BTG2, BTN3A1, BZW1, C1QTNF9B-AS1, C1orf27, C1orf86, C10orf54, C11orf30, C11orf70, C11orf73, C11orf76, C11orf94, C12orf4, C12orf56, C14orf132, C17orf76-AS1, C19orf47, C2orf47, C3, C4orf27, C5orf24, C6orf48, C7orf31, C8orf34, C8orf44, C8orf44-SGK3, C8orf88, C9orf69, CA13, CA3, CAB39, CACNA2D2, CACNB1, CACNB4, CADM1, CADM2, CALU, CAMKK1, CAND2, CAPNS1, CASC3, CASP7, CASP8AP2, CAV1, CCAR1, CCDC77, CCDC79, CCDC88A, CCDC92, CCDC122, CCER2, CCNF, CCNL2, CCT6A, CD276, CD46, CDC25B, CDC40, CDC42BPA, CDCA7, CDH11, CDH13, CDH18, CDK11B, CDK16, CDKAL1, CDKN1C, CECR7, CELSR1, CEMIP, CENPI, CEP112, CEP162, CEP170, CEP192, CEP68, CFH, CFLAR, CHD8, CHEK1, CHRM2, CIITA, CIZ1, CLDN23, CLIC1, CLK4, CLTA, CMAHP, CNGA4, CNOT1, CNRIP1, CNTD1, CMSS1, CNOT7, CNRIP1, CNTN1, COG1, COL1A1, COL11A1, COL12A1, COL14A1, COL15A1, COL5A1, COL5A3, COL6A1, COL6A6, COL8A1, COLEC12, COMP, COPS7B, CPA4, CPEB2, CPQ, CPSF4, CREB5, CRISPLD2, CRLF1, CRLS1, CRTAP, CRX, CRYBG3, CRYL1, CSDE1, CSNK1A1, CSNK1E, CSNK1G1, CTDSP2, CTNND1, CTRC, CUL2, CUL4A, CUX1, CYB5B, CYB5R2, CYBRD1, CYGB, CYP1B1, CYP51A1, DAAM1, DAB2, DACT1, DAGLB, DARS, DAXX, DCAF10, DCAF11, DCAF17, DCBLD2, DCLK1, DCN, DCUN1D4, DDAH1, DDAH2, DDHD2, DDIT4L, DDR1, DDX39B, DDX42, DDX50, DEGS1, DENND1A, DENND1B, DENND4A, DENND5A, DEPTOR, DET1, DFNB59, DGCR2, DGK1, DGKA, DHCR24, DHCR7, DHFR, DHX9, DIAPH1, DIAPH3, DIRAS3, DIS3L, DKFZp434M1735, DKK3, DLC1, DLG5, DMD, DMXL1, DNAH8, DNAH11, DNAJA4, DNAJC3, DNAJC27, DNM2, DNMBP, DOCK1, DOCK11, DPP8, DSEL, DST, DSTN, DYNC1I1, DYRK1A, DZIP1L, EBF1, EEA1, EEFIA1, EFCAB14, EFEMP1, EGR1, EGR3, EHMT2, EIF2B3, EIF4G1, EIF4G2, EIF4G3, ELF2, ELMO2, ELN, ELP4, EMX2OS, ENAH, ENG, ENOX1, ENPP1, ENPP2, ENSA, EP300, EPT1, ERC1, ERC2, ERCC1, ERCC8, ERLN2, ERRFl1, ESM1, ETV5, EVC, EVC2, EXO1, EXOC3, EXOC6B, EXTL2, EYA3, F2R, FADS1, FADS2, FAF1, FAIM, FAM111A, FAM126A, FAM13A, FAM160A1, FAM162A, FAM174A, FAM195B, FAM198B, FAM20A, FAM208B, FAM219A, FAM219B, FAM3C, FAM46B, FAM49B, FAM65A, FAM65B, FAM69B, FAP, FARP1, FBLN2, FBN2, FBXL16, FBXL6, FBXO9, FBXO10, FBXO18, FBXO31, FBXO34, FBXO9, FCHO1, FDFT1, FDPS, FER, FEZ1, FGD4, FGD5-AS1, FGFR2, FGFRL1, FGL2, FHOD3, FLII, FLNB, FLT1, FN1, FNBP1, FOCAD, FOS, FOSB, FOSL1, FOXK1, FRAS1, FSCN2, FUS, FYN, GABPB1, GAL3ST4, GALC, GALNT1, GALNT15, GAS7, GATA6, GBA2, GBGT1, GBP1, GCFC2, GLCE, GCNT1, GDF6, GGACT, GHDC, GIGYF2, GJC1, GLCE, GMIP, GNA13, GNAQ, GNAS, GNG12, GNL3L, GOLGA2, GOLGA4, GOLGB1, GORASP1, GPR1, GPR183, GPR50, GPR89A, GPRC5A, GPRC5B, GPSM2, GREM1, GRK6, GRTP1, GSE1, GTF2H2B, GTSF1, GUCA1B, GULP1, GXYLT1, HAPLN1, HAPLN2, HAS2, HAS3, HAT1, HAUS3, HAUS6, HAVCR2, HDAC5, HDAC7, HDX, HECTD2-AS1, HEG1, HEPH, HEY1, HLA-A, HLA-E, HLTF, HMGA1, HMGA2, HMGB1, HMGCR, HMGN3-AS1, HMGCS1, HMGXB4, HOOK3, HOXB3, HMOX1, HNMT, HNRNPR, HNRNPUL1, HP1BP3, HPS1, HRH1, HSD17B12, HSPA1L, HTATIP2, HTT, IARS, IDH1, IDI1, IFT57, IGDCC4, IGF2BP2, IGF2R, IGFBP3, IKBKAP, IL16, IL6ST, INA, INHBA, INO80, IPP4B, INPP5K, INSIG1, INTU, INVS, IQCE, IQCG, ITCH, ITGA11, ITGA8, ITGAV, ITGB5, ITGB8, ITIH1, ITM2C, ITPKA, ITSN1, IVD, KANSL3, KAT6B, KCNK2, KCNS1, KCNS2, KDM6A, KDSR, KIAA1033, KIAA1143, KIAA1199, KIAA1456, KIAA1462, KIAA1522, KIAA1524, KIAA1549, KIAA1715, KIAA1755, KIDINS220, KIF14, KIF2A, KIF21A, KIF3A, KIT, KLC1, KLC2, KLF17, KLF6, KLHL7, KLRG1, KMT2D, KRT7, KRT18, KRT19, KRT34, KRTAP1-1, KRTAP1-5, KRTAP2-3, L3MBTL2, LAMA2, LAMB1, LAMB2P1, LARP4, LATS2, LDLR, LEMD3, LETM2, LGALS3, LGALS8, LGI2, LGR4, LHX9, LIMS1, LINC00341, LINC00472, LINC00570, LINC00578, LINC00607, LINC00657, LINC00678, LINC00702, LINC00886, LINC00961, LINC01011, LINC01118, LINC01204, LINCR-0002, LINGO2, LMAN2L, LMNA, LMO7, LMOD1, LOC400927, LONP1, LOX, LPHN1, LRBA, LRCH4, LRIG1, LRP4, LRP8, LRRC1, LRRC32, LRRC39, LRRC8A, LSAMP, LSS, LTBR, LUC7L2, LUM, LYPD1, LYRM1, LZTS2, MACROD2, MAFB, MAGED4, MAGED4B, MAMDC2, MAN1A2, MAN2A1, MAN2C1, MANEA, MAP4K4, MAPK10, MAPK13, MARCH7, MARCH8, MASP1, MB, MB21D2, MBD1, MBOAT7, MC4R, MCM10, MDM2, MDN1, MEAF6, MECP2, MED1, MED13L, MEDAG, MEF2D, MEGF6, MEIS2, MEMO1, MEPCE, MFGE8, MFN2, MIAT, MICAL2, MINPP1, MIR612, MKL1, MKLN1, MKNK2, MLLT4, MLLT10, MLST8, MMAB, MMP10, MMP24, MMS19, MMS22L, MN1, MORF4L1, MOXD1, MPPE1, MPZL1, MRPL3, MRPL45, MRPL55, MRPS28, MRVI1, MSANTD3, MSC, MSH2, MSH4, MSH6, MSL3, MSMO1, MSRB3, MTAP, MTERF3, MTERFD1, MTHFD1L, MTMR3, MTMR9, MTRR, MUM1, MVD, MVK, MXRA5, MYADM, MYB, MYCBP2, MYLK, MYO1D, MYO9B, MYOF, NA, NAA35, NAALADL2, NADK, NAE1, NAGS, NASP, NAV1, NAV2, NCOA1, NCOA3, NCOA4, NCSTN, NDNF, NEDD4, NELFA, NEO1, NEURL1B, NF2, NFASC, NFE2L, NFX1, NGF, NGFR, NHLH1, NID1, NID2, NIPA1, NKX3-1, NLGN1, NLN, NOL10, NOMO3, NOTCH3, NOTUM, NOVA2, NOX4, NPEPPS, NRD1, NREP, NRG1, NRROS, NSUN4, NT5C2, NT5E, NTNG1, NUDT4, NUP153, NUP35, NUP50, NUPL1, NUSAP1, OCLN, ODF2, OLR1, OS9, OSBPL3, OSBPL6, OSBPL10, OSMR, OXCT1, OXCT2, P4HA1, P4HB, PABPC1, PAIP2B, PAK4, PAPD4, PARD3, PARN, PARP14, PARP4, PARVB, PAX6, PBLD, PBX3, PCBP2, PCCB, PCDH10, PCDHGB3, PCGF3, PCM1, PCMTD2, PCNXL2, PCSK9, PDE1C, PDE3A, PDE4A, PDE5A, PDE7A, PDGFD, PDGFRB, PDLIM7, PDS5B, PDXDC1, PDXDC2P, PEAR1, PELI1, PEPD, PEX5, PFKP, PHACTR3, PHF19, PHF8, PHRF1, PHTF2, PI4K2A, PIEZO1, PIGN, PIGU, PIK3C2B, PIK3CD, PIK3R1, PIKFYVE, PIM2, PITPNA, PITPNB, PITPNM1, PITPNM3, PLAU, PLEC, PLEK2, PLEKHA1, PLEKHA6, PLEKHB2, PLEKHH2, PLSCR1, PLSCR3, PLXNB2, PLXNC1, PMS1, PNISR, PODN, POLE3, POLN, POLR1A, POLR3D, POMT2, POSTN, POU2F1, PPAPDC1A, PPARA, PPARG, PPFIBP1, PPIP5K1, PPIP5K2, PPM1E, PPP1R12A, PPPR26, PPP3CA, PPP6R1, PPP6R2, PRKCA, PRKDC, PRKG1, PRMT1, PRNP, PRPF31, PRPH2, PRRG4, PRSS23, PRUNE2, PSMA4, PSMC1, PSMD6, PSMD6-AS2, PTCH1, PTGIS, PTK2B, PTPN14, PTX3, PUF60, PUS7, PVR, PXK, PXN, QKI, RAB2B, RAB30, RAB34, RAB38, RAB44, RAD1, RAD9B, RAD23B, RAF1, RALB, RAP1GDS1, RAPGEF1, RARG, RARS, RARS2, RASIP1, RASSF8, RBBP8, RBCK1, RCOR3, RBFOX2, RBKS, RBM10, RDX, RERE, RFTN1, RFWD2, RFX3-AS1, RGCC, RGL1, RGS10, RGS3, RIF1, RNF14, RNF19A, RNF130, RNF144A, RNF213, RNF38, RNFT1, ROR1, ROR2, RPA1, RPF2, RPL10, RPS10, RPS6KB2, RPS6KC1, RRBP1, RWDD4, SAMD4A, SAMD9, SAMD9L, SAR1A, SART3, SCAF4, SCAF8, SCARNA9, SCD, SCLT1, SCO1, SDCBP, SEC14L1, SEC22A, SEC24A, SEC24B, SEC61A, SENP6, SEPT9, SERGEF, SERPINE2, SF1, SF3B3, SGIP1, SGK3, SGMS1, SGOL2, SGPL1, SH2B3, SH3RF1, SH3YL1, SHROOM3, SIGLEC10, SKA2, SKIL, SKP1, SLC12A2, SLC24A3, SLC25A16, SLC25A17, SLC34A3, SLC35F3, SLC39A3, SLC39A10, SLC4A4, SLC4A11, SLC41A1, SLC44A2, SLC46A2, SLC6A15, SLC7A6, SLC7A8, SLC7A11, SLC9A3, SLIT3, SMARCA4, SMARCC2, SMC4, SMC6, SMCHD1, SMG1, SMG1P3, SMOX, SMPD4, SMTN, SMYD3, SMYD5, SNAP23, SNED1, SNHG16, SNX7, SNX14, SNX24, SNX7, SOCS2, SOCS6, SOGA2, SON, SORBS2, SORCS1, SORCS2, SOS2, SOX7, SPATA18, SPATA20, SPATA5, SPATS2, SPDYA, SPEF2, SPG20, SPIDR, SPINK5, SPRED2, SPRYD7, SQLE, SQRDL, SQSTM1, SRCAP, SREBF1, SRGAP1, SRRM1, SRSF3, SSBP1, STAC2, STARD4, STAT1, STAT3, STAT4, STAU1, STC2, STEAP2, STK32B, STRAD8, STRIP1, STRN4, STS, STX16, STXBP4, STXBP6, SULF1, SUPT20H, SVEP1, SYNE1, SYNE2, SYNGR2, SYNPO, SYNPO2, SYNPO2L, SYT15, SYTL2, TACC1, TAF2, TAGLN3, TANC2, TANGO6, TARBP1, TARS, TASP1, TBC1D15, TBCA, TBL1XR1, TBL2, TCF12, TCF4, TCF7L2, TEKT4P2, TENC1, TENM2, TEP1, TET1, TET3, TEX21P, TFCP2, TGFA, TGFB2, TGFB3, TGFB1, TGFBR1, TGFBRAP1, TGM2, THADA, THAP4, THBS2, THRB, TIAM1, TIMP2, TJAP1, TJP2, TLE3, TLK1, TMC3, TMEM67, TMEM102, TMEM119, TMEM134, TMEM154, TMEM189-UBE2V1, TMEM214, TMEM256-PLSCR3, TMEM47, TMEM50B, TMEM63A, TMX3, TNC, TNFAIP3, TNFAIP8L3, TNFRSF12A, TNFRSF4, TNIP1, TNKS1BP1, TNPO3, TNRC18P1, TNS1, TNS3, TNXB, TOE1, TOMM40, TOMM5, TOPORS, TP53AIP1, TP53INP1, TPRG1, TRAF3, TRAK1, TRAPPC12, TRIB1, TRIM2, TRIM23, TRIM26, TRIM28, TRIM65, TRIM66, TRMT1L, TRPC4, TRPS1, TSC2, TSHZ1, TSHZ2, TSPAN11, TSPAN18, TSPAN2, TSPAN7, TSSK3, TTC7A, TTC7B, TUBB2C, TUBB3, TUBE1, TXNIP, TXNL1, TXNL4B, TXNRD1, TYW5, U2SURP, UBAP2L, UBE2D3, UBE2G2, UBE2L3, UBE2V1, UBN2, UBQLN4, UCHL5, UHMK1, UHRF1BP1L, UNC13B, UNC5B, URGCP, URGCP-MRPS24, USP19, USP7, USP27X, UVRAG, VANGL1, VARS2, VAV2, VCL, VDAC2, VIM-AS1, VIPAS39, VPS13A, VPS29, VPS41, VPS51, VSTM2L, VWA8, VWF, WDR19, WDR27, WDR37, WDR48, WDR90, WDR91, WHSC2, WIPF1, WISP1, WNK1, WNT5B, WNT10B, WSB1, WWTR1, XDH, XIAP, XRN2, YAP1, YDJC, YES1, YPEL5, YTHDF3, Z24749, ZAK, ZBTB10, ZBTB24, ZBTB26, ZBTB7A, ZC3H12C, ZC3H14, ZC3H18, ZCCHC5, ZCCHC8, ZCCHC11, ZEB1, ZEB2, ZFAND1, ZFAND5, ZFP82, ZHX3, ZMIZ1, ZMIZ1-AS1, ZMIZ2, ZMYM2, ZNF12, ZNF138, ZNF148, ZNF208, ZNF212, ZNF219, ZNF227, ZNF232, ZNF24, ZNF268, ZNF28, ZNF280D, ZNF281, ZNF335, ZNF350, ZNF37A, ZNF37BP, ZNF395, ZNF426, ZNF431, ZNF583, ZNF618, ZNF621, ZNF652, ZNF655, ZNF660, ZNF674, ZNF680, ZNF730, ZNF74, ZNF764, ZNF777, ZNF778, ZNF780A, ZNF7804A, ZNF79, ZNF827, ZNF836, ZNF837, ZNF839, ZNF91 and ZSCAN25.

In another particular aspect, provided herein is a method for modifying RNA splicing in order to produce a mature mRNA transcript having an iExon, the method comprising contacting a cell or cell lysate containing a pre-mRNA transcript with a compound of Formula (I) or a form thereof, wherein the pre-mRNA transcript comprises two exons and an intron, wherein a first exon is upstream of the intron and a second exon is downstream of the intron, wherein the intron comprises in 5' to 3' order: a first 5' splice site, a first branch point, a first 3' splice site, an endogenous or non-endogenous intronic recognition element for splicing modifier (iREMS), a second branch point, and a second 3' splice site, wherein the iREMS comprises an RNA sequence GAgurngn, wherein r is adenine or guanine and n is any nucleotide, and wherein the pre-mRNA transcript is a pre-mRNA transcript of a gene that is not SMN2.

In another particular aspect, provided herein is a method for modifying RNA splicing in order to produce a mature mRNA transcript having an iExon, the method comprising contacting a cell or cell lysate containing a pre-mRNA transcript with a compound of Formula (I) or a form thereof, wherein the pre-mRNA transcript comprises two exons and an intron, wherein a first exon is upstream of the intron and a second exon is downstream of the intron, wherein the intron comprises in 5' to 3' order: a first 5' splice site, a first branch point, a first 3' splice site, an endogenous or non-endogenous intronic recognition element for splicing modifier (iREMS), a second branch point, and a second 3' splice site, wherein the iREMS comprises an RNA sequence GAgurngn, wherein r is adenine or guanine and n is any nucleotide, and wherein the pre-mRNA transcript is a pre-mRNA transcript of a gene that is not selected from ABHD10, ADAM12, AKT1, ANXA11, APLP2, APPL2, ARMCX6, ATG5, AXIN1, BAIAP2, CCNB1IP1, CCT7, CEP57, CSF1, DLGAP4, EPN1, ERGIC3, FOXM1, GGCT, GRAMD3, HSD17B4, LARP7, LRRC42, MADD, MAN1B1, MRPL39, PCBP4, PPHLN1, PRKACB, RAB23, RAP1A, RCC1, SREK1, STRN3 and TNRC6A.

In another particular aspect, provided herein is a method for modifying RNA splicing in order to produce a mature mRNA transcript having an iExon, the method comprising contacting a cell or cell lysate containing a pre-mRNA transcript with a compound of Formula (I) or a form thereof, wherein the pre-mRNA transcript comprises two exons and an intron, wherein a first exon is upstream of the intron and a second exon is downstream of the intron, wherein the intron comprises in 5' to 3' order: a first 5' splice site, a first branch point, a first 3' splice site, an endogenous or non-endogenous intronic recognition element for splicing modifier (iREMS), a second branch point, and a second 3' splice site, wherein the iREMS comprises an RNA sequence GAgurngn, wherein r is adenine or guanine and n is any nucleotide, and wherein the pre-mRNA transcript is a pre-mRNA transcript of a gene that is not selected from ABHD10, ADAM12, AKT1, ANXA11, APLP2, APPL2, ARMCX6, ATG5, AXIN1, BAIAP2, CCNB1IP1, CCT7, CEP57, CSF1, DLGAP4, EPN1, ERGIC3, FOXM1, GGCT, GRAMD3, HSD17B4, LARP7, LRRC42, MADD, MAN1B1, MRPL39, PCBP4, PPHLN1, PRKACB, RAB23, RAP1A, RCC1, SMN2, SREK1, STRN3 and TNRC6A.

In another aspect, provided herein is a method for modifying RNA splicing in order to modulate the amount of a mature mRNA transcript produced by a pre-mRNA transcript, wherein the pre-mRNA transcript comprises two exons and an intron, wherein a first exon is upstream of the intron and a second exon is downstream of the intron, wherein the intron comprises a RNA nucleotide sequence comprising in 5' to 3' order: an endogenous or non-endogenous intronic recognition element for splicing modifier (iREMS), a branch point, and a 3' splice site, wherein the iREMS comprises an RNA sequence GAgurngn, wherein r is adenine or guanine and n is any nucleotide.

In one aspect, provided herein is a method for modifying RNA splicing in order to modulate the amount of a mature mRNA transcript produced by a pre-mRNA transcript, the method comprising contacting the pre-mRNA transcript with a compound of Formula (I) or a form thereof, wherein the pre-mRNA transcript comprises two exons and an intron, wherein a first exon is upstream of the intron and a second exon is downstream of the intron, wherein the intron comprises a RNA nucleotide sequence comprising in 5' to 3' order: an endogenous or non-endogenous intronic recognition element for splicing modifier (iREMS), a branch point, and a 3' splice site, wherein the iREMS comprises an RNA sequence GAgurngn, wherein r is adenine or guanine and n is any nucleotide.

In another aspect, provided herein is a method for modifying RNA splicing in order to modulate the amount of a mature mRNA transcript produced by a pre-mRNA transcript, the method comprising contacting a cell or cell lysate containing the pre-mRNA transcript with a compound of Formula (I) or a form thereof, wherein the pre-mRNA transcript comprises two exons and an intron, wherein a first exon is upstream of the intron and a second exon is downstream of the intron, wherein the intron comprises a RNA nucleotide sequence comprising in 5' to 3' order: an endogenous or non-endogenous intronic recognition element for splicing modifier (iREMS), a branch point, and a 3' splice site, wherein the iREMS comprises an RNA sequence GAgurngn, wherein r is adenine or guanine and n is any nucleotide. In some aspects, the intron further comprises in 5' to 3' order: a 5' splice site, a branch point, and a 3' splice site upstream of the iREMS. In some aspects, the pre-mRNA transcript is encoded by a gene disclosed herein (e.g., in a table herein).

In a particular aspect, provided herein is a method for modifying RNA splicing in order to modulate the amount of a mature mRNA transcript produced by a pre-mRNA transcript, the method comprising contacting the pre-mRNA transcript with a compound of Formula (I) or a form thereof, wherein the pre-mRNA transcript comprises two exons and an intron, wherein a first exon is upstream of the intron and a second exon is downstream of the intron, wherein the intron comprises a RNA nucleotide sequence comprising in 5' to 3' order: an endogenous or non-endogenous intronic recognition element for splicing modifier (iREMS), a branch point, and a 3' splice site, wherein the iREMS comprises an RNA sequence GAgurngn, wherein r is adenine or guanine and n is any nucleotide, and wherein the pre-mRNA transcript is a pre-mRNA transcript of a gene that is selected from ABCA10, ABCB8, ABCC3, ACTA2, ADAL, ADAMTS1, ADCY3, ADD1, ADGRG6, ADH6, ADHFE1, AFF3, AGPAT4, AKAP3, ANK1, ANK3, ANKRA2, ANKRD33B, ANKRD36, AP4B1-AS1, APIP, ARHGAP1, ARHGAP12, ARHGEF16, ARID5B, ARL15, ARL9, ARMCX6, ASIC1, ATG5, ATP2A3, ATXN1, B3GALT2, B3GNT6, BCL2L15, BCYRN1, BECN1, BHMT2, BIN3-IT1, BIRC3, BIRC6, BTG2, BTN3A1, C10orf54, C11orf70, C11orf94, C12orf4, C12orf56, C14orf132, C19orf47, C1orf86, C3, C7orf31, C8orf34, C8orf44, C8orf44-SGK3, C8orf88, CA13, CA3, CACNA2D2, CACNB1, CADM1, CAND2, CASP7, CCDC122, CCDC79, CCER2, CCNF, CECR7, CELSR1, CEMIP, CENPI, CEP112, CEP170, CEP192, CFH, CHEK1, CIITA, CLDN23, CLTA, CMAHP, CNGA4, CNRIP1, CNTD1, COL11A1, COL14A1, COL15A1, COL5A1, COL5A3, COL6A6, COL8A1, COLEC12, COMP, CPA4, CPQ, CPSF4, CRISPLD2, CRLF1, CRYBG3, CRYL1, CSNK1E, CSNK1G1, CYB5R2, CYGB, CYP1B1, DAGLB, DCAF17, DCLK1, DCN, DDIT4L, DDX50, DEGS1, DEPTOR, DFNB59, DIRAS3, DLG5, DLGAP4, DNAH8, DNAJC13, DNAJC27, DNMBP, DOCK11, DYNC1I1, DYRK1A, DZIP1L, EFEMP1, EGR3, ELN, ELP4, EMX2OS, ENAH, ENPP1, EP300, ERCC1, ERCC8, ERGIC3, ERLIN2, ERRFI1, ESM1, EVC, EVC2, F2R, FAIM, FAM126A, FAM13A, FAM160A1, FAM162A, FAM174A, FAM20A, FAM46B, FAM65B, FAP, FARP1, FBLN2, FBN2, FBXL6, FCHO1, FGFR2, FGL2, FLT1, FRAS1, FSCN2, GAL3ST4, GALNT15, GATA6, GBGT1, GCNT1, GDF6, GGACT, GLCE, GNAQ, GPR183, GPR50, GPRC5A, GPRC5B, GRTP1, GUCA1B, GULP1, GXYLT1, HAPLN1, HAPLN2, HAS3, HAVCR2, HDAC5, HDX, HECTD2-AS1, HEPH, HEY1, HMGA2, HMGN3-AS1, HNMT, HOOK3, HPS1, HSPA1L, HTATIP2, IFT57, IGDCC4, IGF2R, IGFBP3, IL16, INA, INPP5K, INTU, IQCG, ITGA11, ITGA8, ITGB8, ITIH1, ITPKA, IVD, KAT6B, KCNS1, KCNS2, KDM6A, KDSR, KIAA1456, KIAA1462, KIAA1755, KIT, KLF17, KLRG1, KMT2D, KRT7, KRTAP1-1, KRTAP1-5, L3MBTL2, LAMB2P1, LETM2, LGI2, LGR4, LHX9, LINC00472, LINC00570, LINC00578, LINC00607, LINC00678, LINC00702, LINC00886, LINC00961, LINC01011, LINC01118, LINC01204, LMOD1, LOC400927, LRBA, LRP4, LRRC32, LRRC39, LRRC42, LSAMP, LUM, LYPD1, LYRM1, MAFB, MAMDC2, MAN2A1, MAN2C1, MAPK13, MASP1, MB, MB21D2, MC4R, MCM10, MED13L, MEGF6, MFN2, MIAT, MIR612, MLLT10, MMP10, MMP24, MN1, MOXD1, MRPL45, MRPL55, MRPS28, MRVI1, MSH4, MTERF3, MXRA5, MYCBP2, NA, NAALADL2, NAE1, NAGS, NDNF, NGF, NGFR, NHLH1, NLN, NOTCH3, NOTUM, NOVA2, NOX4, NRROS, OCLN, OLR1, OSBPL10, OXCT1, OXCT2, PAIP2B, PBLD, PDE1C, PDE5A, PDGFD, PDGFRB, PDS5B, PEAR1, PHACTR3, PIGN, PIK3CD, PIK3R1, PIKFYVE, PIM2, PITPNM3, PLEK2, PLEKHA1, PLEKHA6, PLEKHH2, PLSCR1, PNISR, PODN, POLN, POLR1A, POMT2, PPARG, PPIP5K2, PPM1E, PPPR26, PPP3CA, PRKCA, PRKG1, PRPF31, PRPH2, PRRG4, PRUNE2, PSMD6-AS2, PTGIS, PTX3, PXK, RAB30, RAB38, RAB44, RAD9B, RAF1, RAPGEF1, RARS, RARS2, RBBP8, RBKS, RDX, RERE, RFX3-AS1, RGCC, ROR1, ROR2, RPA1, RPS10, RPS6KB2, SAMD4A, SCARNA9, SEC24A, SENP6, SERGEF, SGK3, SH3YL1, SHROOM3, SIGLEC10, SKA2, SLC12A2, SLC24A3, SLC35F3, SLC39A10, SLC44A2, SLC46A2, SLC4A11, SLC6A15, SLC7A11, SLC9A3, SLIT3, SMG1P3, SMTN, SNED1, SNX7, SORBS2, SORCS2, SOX7, SPATA18, SPATA5, SPDYA, SPEF2, SPIDR, SPRYD7, SRGAP1, SRRM1, STAC2, STAT4, STK32B, STRN4, STS, STXBP6, SULF1, SVEP1, SYNGR2, SYNPO, SYNPO2, SYNPO2L, TAGLN3, TANGO6, TASP1, TCF12, TCF4, TGFA, TGFB2, TGFB3, TGM2, THBS2, TIAM1, TMC3, TMEM102, TMEM119, TMEM134, TMEM189-UBE2V1, TMEM214, TMEM256-PLSCR3, TMEM50B, TNFAIP8L3, TNFRSF14, TNRC18P1, TNRC6A, TNXB, TP53AIP1, TPRG1, TRIM66, TRPC4, TSHZ2, TSPAN11, TSPAN18, TSPAN7, TSSK3, TTC7B, TUBE1, TXNIP, TYW5, URGCP, USP27X, UVRAG, VAV2, VIM-AS1, VPS41, VSTM2L, VWF, WDR27, WDR91, WISP1, WNK1, WNT10B, YDJC, ZBTB26, ZCCHC5, ZCCHC8, ZFP82, ZMIZ1-AS1, ZNF138, ZNF212, ZNF232, ZNF350, ZNF431, ZNF660, ZNF680, ZNF79, and ZNF837.

In a particular aspect, provided herein is a method for modifying RNA splicing in order to modulate the amount of a mature mRNA transcript produced by a pre-mRNA transcript, the method comprising contacting a cell or cell lysate containing the pre-mRNA transcript with a compound of Formula (I) or a form thereof, wherein the pre-mRNA transcript comprises two exons and an intron, wherein a first exon is upstream of the intron and a second exon is downstream of the intron, wherein the intron comprises a RNA nucleotide sequence comprising in 5' to 3' order: an endogenous or non-endogenous intronic recognition element for splicing modifier (iREMS), a branch point, and a 3' splice site, wherein the iREMS comprises an RNA sequence GAgurngn, wherein r is adenine or guanine and n is any nucleotide, and wherein the pre-mRNA transcript is a pre-mRNA transcript of a gene that is selected from ABCA10, ABCB8, ABCC3, ACTA2, ADAL, ADAMTS1, ADCY3, ADD1, ADGRG6, ADH6, ADHFE1, AFF3, AGPAT4, AKAP3, ANK1, ANK3, ANKRA2, ANKRD33B, ANKRD36, AP4B1-AS1, APIP, ARHGAP1, ARHGAP12, ARHGEF16, ARID5B, ARL15, ARL9, ARMCX6, ASIC1, ATG5, ATP2A3, ATXN1, B3GALT2, B3GNT6, BCL2L15, BCYRN1, BECN1, BHMT2, BIN3-IT1, BIRC3, BIRC6, BTG2, BTN3A1, C10orf54, C11orf70, C11orf94, C12orf4, C12orf56, C14orf132, C19orf47, C1orf86, C3, C7orf31, C8orf34, C8orf44, C8orf44-SGK3, C8orf88, CA13, CA3, CACNA2D2, CACNB1, CADM1, CAND2, CASP7, CCDC122, CCDC79, CCER2, CCNF, CECR7, CELSR1, CEMIP, CENPI, CEP112, CEP170, CEP192, CFH, CHEK1, CIITA, CLDN23, CLTA, CMAHP, CNGA4, CNRIP1, CNTD1, COL11A1, COL14A1, COL15A1, COL5A1, COL5A3, COL6A6, COL8A1, COLEC12, COMP, CPA4, CPQ, CPSF4, CRISPLD2, CRLF1, CRYBG3, CRYL1, CSNK1E, CSNK1G1, CYB5R2, CYGB, CYP1B1, DAGLB, DCAF17, DCLK1, DCN, DDIT4L, DDX50, DEGS1, DEPTOR, DFNB59, DIRAS3, DLG5, DLGAP4, DNAH8, DNAJC13, DNAJC27, DNMBP, DOCK11, DYNC1I1, DYRK1A, DZIP1L, EFEMP1, EGR3, ELN, ELP4, EMX2OS, ENAH, ENPP1, EP300, ERCC1, ERCC8, ERGIC3, ERLIN2, ERRFI1, ESM1, EVC, EVC2, F2R, FAIM, FAM126A, FAM13A, FAM160A, FAM162A, FAM174A, FAM20A, FAM46B, FAM65B, FAP, FARP1, FBLN2, FBN2, FBXL6, FCHO1, FGFR2, FGL2, FLT1, FRAS1, FSCN2, GAL3ST4, GALNT15, GATA6, GBGT1, GCNT1, GDF6, GGACT, GLCE, GNAQ, GPR183, GPR50, GPRC5A, GPRC5B, GRTP1, GUCA1B, GULP1, GXYLT1, HAPLN1, HAPLN2, HAS3, HAVCR2, HDAC5, HDX, HECTD2-AS1, HEPH, HEY1, HMGA2, HMGN3-AS1, HNMT, HOOK3, HPS1, HSPA1L, HTATIP2, IFT57, IGDCC4, IGF2R, IGFBP3, IL16, INA, INPP5K, INTU, IQCG, ITGA11, ITGA8, ITGB8, ITIH1, ITPKA, IVD, KAT6B, KCNS1, KCNS2, KDM6A, KDSR, KIAA1456, KIAA1462, KIAA1755, KIT, KLF17, KLRG1, KMT2D, KRT7, KRTAP1-1, KRTAP1-5, L3MBTL2, LAMB2P1, LETM2, LGI2, LGR4, LHX9, LINC00472, LINC00570, LINC00578, LINC00607, LINC00678, LINC00702, LINC00886, LINC00961, LINC01011, LINC01118, LINC01204, LMOD1, LOC400927, LRBA, LRP4, LRRC32, LRRC39, LRRC42, LSAMP, LUM, LYPD1, LYRM1, MAFB, MAMDC2, MAN2A1, MAN2C1, MAPK13, MASP1, MB, MB21D2, MC4R, MCM10, MED13L, MEGF6, MFN2, MIAT, MIR612, MLLT10, MMP10, MMP24, MN1, MOXD1, MRPL45, MRPL55, MRPS28, MRVI1, MSH4, MTERF3, MXRA5, MYCBP2, NA, NAALADL2, NAE1, NAGS, NDNF, NGF, NGFR, NHLH1, NLN, NOTCH3, NOTUM, NOVA2, NOX4, NRROS, OCLN, OLR1, OSBPL10, OXCT1, OXCT2, PAIP2B, PBLD, PDE1C, PDE5A, PDGFD, PDGFRB, PDS5B, PEAR1, PHACTR3, PIGN, PIK3CD, PIK3R1, PIKFYVE, PIM2, PITPNM3, PLEK2, PLEKHA1, PLEKHA6, PLEKHH2, PLSCR1, PNISR, PODN, POLN, POLR1A, POMT2, PPARG, PPIP5K2, PPM1E, PPP1R26, PPP3CA, PRKCA, PRKG1, PRPF31, PRPH2, PRRG4, PRUNE2, PSMD6-AS2, PTGIS, PTX3, PXK, RAB30, RAB38, RAB44, RAD9B, RAF1, RAPGEF1, RARS, RARS2, RBBP8, RBKS, RDX, RERE, RFX3-AS1, RGCC, ROR1, ROR2, RPA1, RPS10, RPS6KB2, SAMD4A, SCARNA9, SEC24A, SENP6, SERGEF, SGK3, SH3YL1, SHROOM3, SIGLEC10, SKA2, SLC12A2, SLC24A3, SLC35F3, SLC39A10, SLC44A2, SLC46A2, SLC4A11, SLC6A15, SLC7A11, SLC9A3, SLIT3, SMG1P3, SMTN, SNED1, SNX7, SORBS2, SORCS2, SOX7, SPATA18, SPATA5, SPDYA, SPEF2, SPIDR, SPRYD7, SRGAP1, SRRM1, STAC2, STAT4, STK32B, STRN4, STS, STXBP6, SULF1, SVEP1, SYNGR2, SYNPO, SYNPO2, SYNPO2L, TAGLN3, TANGO6, TASP1, TCF12, TCF4, TGFA, TGFB2, TGFB3, TGM2, THBS2, TIAM1, TMC3, TMEM102, TMEM119, TMEM134, TMEM189-UBE2V1, TMEM214, TMEM256-PLSCR3, TMEM50B, TNFAIP8L3, TNFRSF14, TNRC18P1, TNRC6A, TNXB, TP53AIP1, TPRG1, TRIM66, TRPC4, TSHZ2, TSPAN11, TSPAN18, TSPAN7, TSSK3, TTC7B, TUBE1, TXNIP, TYW5, URGCP, USP27X, UVRAG, VAV2, VIM-AS1, VPS41, VSTM2L, VWF, WDR27, WDR91, WISP1, WNK1, WNT10B, YDJC, ZBTB26, ZCCHC5, ZCCHC8, ZFP82, ZMIZ1-AS1, ZNF138, ZNF212, ZNF232, ZNF350, ZNF431, ZNF660, ZNF680, ZNF79, and ZNF837. In some aspects, the intron further comprises a first 5' splice site, a second branch point, and a second 3' splice site upstream of the iREMS.

In a particular aspect, provided herein is a method for modifying RNA splicing in order to modulate the amount of a mature mRNA transcript produced by a pre-mRNA transcript, the method comprising contacting a cell or cell lysate containing the pre-mRNA transcript with a compound of Formula (I) or a form thereof, wherein the pre-mRNA transcript comprises two exons and an intron, wherein a first exon is upstream of the intron and a second exon is downstream of the intron, wherein the intron comprises a RNA nucleotide sequence comprising in 5' to 3' order: an endogenous or non-endogenous intronic recognition element for splicing modifier (iREMS), a branch point, and a 3' splice site, wherein the iREMS comprises an RNA sequence GAgurngn, wherein r is adenine or guanine and n is any nucleotide, and wherein the pre-mRNA transcript is a pre-mRNA transcript of a gene that is selected from ABCA1, ABCA10, ABCB7, ABCB8, ABCC1, ABCC3, ABHD10, ABL2, ABLIM3, ACACA, ACADVL, ACAT2, ACTA2, ADAL, ADAM12, ADAM15, ADAM17, ADAM23, ADAM33, ADAMTS1, ADAMTS19, ADCY3, ADD1, ADGRG6, ADH6, ADHFE1, AFF2, AFF3, AGK, AGPAT3, AGPAT4, AGPS, AHCYL2, AHDC1, AHRR, AJUBA, AK021888, AK310472, AKAP1, AKAP3, AKAP8L, AKAP9, AKNA, AKT1, ALCAM, ALDH4A1, AMPD2, ANK1, ANK2, ANK3, ANKFY1, ANKHD1-EIF4EBP3, ANKRA2, ANKRD13C, ANKRD17, ANKRD33B, ANKRD36, ANKS6, ANP32A, ANXA11, ANXA6, AP2B1, AP4B1-AS1, APAF1, APIP, APLP2, APOA2, APP, APPL2, APTX, ARHGAP1, ARHGAP12, ARHGAP22, ARHGAP5, ARHGEF16, ARID1A, ARID2, ARID5B, ARL9, ARL15, ARL5B, ARMCX3, ARMCX6, ARSJ, ASAP1, ASIC1, ASL, ASNS, ASPH, ATAD2B, ATF6, ATF7IP, ATG5, ATG9A, ATMIN, ATP2A3, ATP2C1, ATXN1, ATXN3, AURKA, AXIN1, B3GALT2, B3GNT6, B4GALT2, BACE1, BAG2, BASP1, BC033281, BCAR3, BCL2L15, BCYRN1, BECN1, BEND6, BHMT2, BICD1, BIN1, BIN3, BIN3-IT1, BIRC3, BIRC6, BNC1, BNC2, BRCA1, BRCA2, BRD2, BRPF1, BSCL2, BTBD10, BTG2, BTN3A1, BZW1, C1QTNF9B-AS1, C1orf27, C1orf86, C10orf54, C11orf30, C11orfl70, C1orf73, C11orf76, C11orf94, C12orf4, C12orf56, C14orf132, C17orf76-AS1, C19orf47, C2orf47, C3, C4orf27, C5orf24, C6orf48, C7orf31, C8orf34, C8orf44, C8orf44-SGK3, C8orf88, C9orf69, CA13, CA3, CAB39, CACNA2D2, CACNB1, CACNB4, CADM1, CADM2, CALU, CAMKK1, CAND2, CAPNS1, CASC3, CASP7, CASP8AP2, CAV1, CCAR1, CCDC77, CCDC79, CCDC88A, CCDC92, CCDC122, CCER2, CCNF, CCNL2, CCT6A, CD276, CD46, CDC25B, CDC40, CDC42BPA, CDCA7, CDH11, CDH13, CDH18, CDK11B, CDK16, CDKAL1, CDKN1C, CECR7, CELSR1, CEMIP, CENPI, CEP112, CEP162, CEP170, CEP192, CEP57, CEP68, CFH, CFLAR, CHD8, CHEK1, CHRM2, CITA, CIZ1, CLDN23, CLIC1, CLK4, CLTA, CMAHP, CNGA4, CNOT1, CNRIP1, CNTD1, CMSS1, CNOT7, CNRIP1, CNTN1, COG1, COL1A1, COL11A1, COL12A1, COL14A1, COL15A1, COL5A1, COL5A3, COL6A1, COL6A6, COL8A1, COLEC12, COMP, COPS7B, CPA4, CPEB2, CPQ, CPSF4, CREB5, CRISPLD2, CRLF1, CRLS1, CRTAP, CRX, CRYBG3, CRYL1, CSDE1, CSNK1A1, CSNK1E, CSNK1G1, CTDSP2, CTNND1, CTRC, CUL2, CUL4A, CUX1, CYB5B, CYB5R2, CYBRD1, CYGB, CYP1B1, CYP51A1, DAAM1, DAB2, DACT1, DAGLB, DARS, DAXX, DCAF10, DCAF11, DCAF17, DCBLD2, DCLK1, DCN, DCUN1D4, DDAH1, DDAH2, DDHD2, DDIT4L, DDR1, DDX39B, DDX42, DDX50, DEGS1, DENND1A, DENND1B, DENND4A, DENND5A, DEPTOR, DET1, DFNB59, DGCR2, DGK1, DGKA, DHCR24, DHCR7, DHFR, DHX9, DIAPH1, DIAPH3, DIRAS3, DIS3L, DKFZp434M1735, DKK3, DLC1, DLG5, DLGAP4, DMD, DMXL1, DNAH8, DNAH11, DNAJA4, DNAJC13, DNAJC27, DNM2, DNMBP, DOCK1, DOCK11, DPP8, DSEL, DST, DSTN, DYNC1I1, DYRK1A, DZIP1L, EBF1, EEA1, EEF1A1, EFCAB14, EFEMP1, EGR1, EGR3, EHMT2, EIF2B3, EIF4G1, EIF4G2, EIF4G3, ELF2, ELMO2, ELN, ELP4, EMX2OS, ENAH, ENG, ENOX1, ENPP1, ENPP2, ENSA, EP300, EPN1, EPT1, ERC1, ERC2, ERCC1, ERCC8, ERGIC3, ERLIN2, ERRFI1, ESM1, ETV5, EVC, EVC2, EXO1, EXOC3, EXOC6B, EXTL2, EYA3, F2R, FADS1, FADS2, FAF1, FAIM, FAM111A, FAM126A, FAM13A, FAM160A1, FAM162A, FAM174A, FAM195B, FAM198B, FAM20A, FAM208B, FAM219A, FAM219B, FAM3C, FAM46B, FAM49B, FAM65A, FAM65B, FAM69B, FAP, FARP1, FBLN2, FBN2, FBXL16, FBXL6, FBXO9, FBXO10, FBXO18, FBXO31, FBXO34, FBXO9, FCHO1, FDFT1, FDPS, FER, FEZ1, FGD4, FGD5-AS1, FGFR2, FGFRL1, FGL2, FHOD3, FLII, FLNB, FLT1, FN1, FNBP1, FOCAD, FOS, FOSB, FOSL1, FOXK1, FOXM1, FRAS1, FSCN2, FUS, FYN, GABPB1, GAL3ST4, GALC, GALNT1, GALNT15, GAS7, GATA6, GBA2, GBGT1, GBP1, GCFC2, GLCE, GCNT1, GDF6, GGACT, GGCT, GHDC, GIGYF2, GJC1, GLCE, GMIP, GNA13, GNAQ, GNAS, GNG12, GNL3L, GOLGA2, GOLGA4, GOLGB1, GORASP1, GPR1, GPR183, GPR50, GPR89A, GPRC5A, GPRC5B, GPSM2, GREM1, GRK6, GRTP1, GSE1, GTF2H2B, GTSF1, GUCA1B, GULP1, GXYLT1, HAPLN1, HAPLN2, HAS2, HAS3, HAT1, HAUS3, HAUS6, HAVCR2, HDAC5, HDAC7, HDX, HECTD2-AS1, HEG1, HEPH, HEY1, HLA-A, HLA-E, HLTF, HMGA1, HMGA2, HMGB1, HMGCR, HMGN3-AS1, HMGCS1, HMGXB4, HOOK3, HOXB3, HMOX1, HNMT, HNRNPR, HNRNPUL1, HP1BP3, HPS1, HRH1, HSD17B12, HSD17B4, HSPA1L, HTATIP2, HTT, IARS, IDH1, IDI1, IFT57, IGDCC4, IGF2BP2, IGF2R, IGFBP3, IKBKAP, IL16, IL6ST, INA, INHBA, INO80, IPP4B, INPP5K, INSIG1, INTU, INVS, IQCE, IQCG, ITCH, ITGAI1, ITGA8, ITGAV, ITGB5, ITGB8, ITIH1, ITM2C, ITPKA, ITSN1, IVD, KANSL3, KAT6B, KCNK2, KCNS1, KCNS2, KDM6A, KDSR, KIAA1033, KIAA1143, KIAA1199, KIAA1456, KIAA1462, KIAA1522, KIAA1524, KIAA1549, KIAA1715, KIAA1755, KIDINS220, KIF14, KIF2A, KIF21A, KIF3A, KIT, KLC1, KLC2, KLF17, KLF6, KLHL7, KLRG1, KMT2D, KRT7, KRT18, KRT19, KRT34, KRTAP1-1, KRTAP1-5, KRTAP2-3, L3MBTL2, LAMA2, LAMB1, LAMB2P1, LARP4, LARP7, LATS2, LDLR, LEMD3, LETM2, LGALS3, LGALS8, LGI2, LGR4, LHX9, LIMS1, LINC00341, LINC00472, LINC00570, LINC00578, LINC00607, LINC00657, LINC00678, LINC00702, LINC00886, LINC00961, LINC01011, LINC01118, LINC01204, LINCR-0002, LINGO2, LMAN2L, LMNA, LMO7, LMOD1, LOC400927, LONP1, LOX, LPHN1, LRBA, LRCH4, LRIG1, LRP4, LRP8, LRRC1, LRRC32, LRRC39, LRRC42, LRRC8A, LSAMP, LSS, LTBR, LUC7L2, LUM, LYPD1, LYRM1, LZTS2, MACROD2, MADD, MAFB, MAGED4, MAGED4B, MAMDC2, MAN1A2, MAN2A1, MAN2C1, MANEA, MAP4K4, MAPK10, MAPK13, MARCH7, MARCH8, MASP1, MB, MB21D2, MBD1, MBOAT7, MC4R, MCM10, MDM2, MDN1, MEAF6, MECP2, MED1, MED13L, MEDAG, MEF2D, MEGF6, MEIS2, MEMO1, MEPCE, MFGE8, MFN2, MIAT, MICAL2, MINPP1, MIR612, MKL1, MKLN1, MKNK2, MLLT4, MLLT10, MLST8, MMAB, MMP10, MMP24, MMS19, MMS22L, MN1, MORF4L1, MOXD1, MPPE1, MPZL1, MRPL3, MRPL39, MRPL45, MRPL55, MRPS28, MRVI1, MSANTD3, MSC, MSH2, MSH4, MSH6, MSL3, MSMO1, MSRB3, MTAP, MTERF3, MTERFD1, MTHFD1L, MTMR3, MTMR9, MTRR, MUM1, MVD, MVK, MXRA5, MYADM, MYB, MYCBP2, MYLK, MYO1D, MYO9B, MYOF, NA, NAA35, NAALADL2, NADK, NAE1, NAGS, NASP, NAV1, NAV2, NCOA1, NCOA3, NCOA4, NCSTN, NDNF, NEDD4, NELFA, NEO1, NEURL1B, NF2, NFASC, NFE2L1, NFX1, NGF, NGFR, NHLH1, NID1, NID2, NIPA1, NKX3-1, NLGN1, NLN, NOL10, NOMO3, NOTCH3, NOTUM, NOVA2, NOX4, NPEPPS, NRD1, NREP, NRG1, NRROS, NSUN4, NT5C2, NT5E, NTNG1, NUDT4, NUP153, NUP35, NUP50, NUPL1, NUSAP1, OCLN, ODF2, OLR1, OS9, OSBPL3, OSBPL6, OSBPL10, OSMR, OXCT1, OXCT2, P4HA1, P4HB, PABPC1, PAIP2B, PAK4, PAPD4, PARD3, PARN, PARP14, PARP4, PARVB, PAX6, PBLD, PBX3, PCBP2, PCBP4, PCCB, PCDH10, PCDHGB3, PCGF3, PCM1, PCMTD2, PCNXL2, PCSK9, PDE1C, PDE3A, PDE4A, PDE5A, PDE7A, PDGFD, PDGFRB, PDLIM7, PDS5B, PDXDC1, PDXDC2P, PEAR1, PELI1, PEPD, PEX5, PFKP, PHACTR3, PHF19, PHF8, PHRF1, PHTF2, PI4K2A, PIEZO1, PIGN, PIGU, PIK3C2B, PIK3CD, PIK3R1, PIKFYVE, PIM2, PITPNA, PITPNB, PITPNM1, PITPNM3, PLAU, PLEC, PLEK2, PLEKHA1, PLEKHA6, PLEKHB2, PLEKHH2, PLSCR1, PLSCR3, PLXNB2, PLXNC1, PMS1, PNISR, PODN, POLE3, POLN, POLR1A, POLR3D, POMT2, POSTN, POU2F1, PPAPDC1A, PPARA, PPARG, PPFIBP1, PPHLN1, PPIP5K1, PPIP5K2, PPM1E, PPP1R12A, PPP1R26, PPP3CA, PPP6R1, PPP6R2, PRKACB, PRKCA, PRKDC, PRKG1, PRMT1, PRNP, PRPF31, PRPH2, PRRG4, PRSS23, PRUNE2, PSMA4, PSMC1, PSMD6, PSMD6-AS2, PTCH1, PTGIS, PTK2B, PTPN14, PTX3, PUF60, PUS7, PVR, PXK, PXN, QKI, RAB23, RAB2B, RAB30, RAB34, RAB38, RAB44, RAD1, RAD9B, RAD23B, RAF1, RALB, RAP1A, RAP1GDS1, RAPGEF1, RARG, RARS, RARS2, RASIP1, RASSF8, RBBP8, RBCK1, RCOR3, RBFOX2, RBKS, RBM10, RCC1, RDX, RERE, RFTN1, RFWD2, RFX3-AS1, RGCC, RGL1, RGS10, RGS3, RIF1, RNF14, RNF19A, RNF130, RNF144A, RNF213, RNF38, RNFT1, ROR1, ROR2, RPA1, RPF2, RPL10, RPS10, RPS6KB2, RPS6KC1, RRBP1, RWDD4, SAMD4A, SAMD9, SAMD9L, SAR1A, SART3, SCAF4, SCAF8, SCARNA9, SCD, SCLT1, SCO1, SDCBP, SEC14L1, SEC22A, SEC24A, SEC24B, SEC61A1, SENP6, SEPT9, SERGEF, SERPINE2, SF1, SF3B3, SGIP1, SGK3, SGMS1, SGOL2, SGPL1, SH2B3, SH3RF1, SH3YL1, SHROOM3, SIGLEC10, SKA2, SKIL, SKP1, SLC12A2, SLC24A3, SLC25A16, SLC25A17, SLC34A3, SLC35F3, SLC39A3, SLC39A10, SLC4A4, SLC4A11, SLC41A1, SLC44A2, SLC46A2, SLC6A15, SLC7A6, SLC7A8, SLC7A11, SLC9A3, SLIT3, SMARCA4, SMARCC2, SMC4, SMC6, SMCHD1, SMG1, SMG1P3, SMN2, SMOX, SMPD4, SMTN, SMYD3, SMYD5, SNAP23, SNED1, SNHG16, SNX7, SNX14, SNX24, SNX7, SOCS2, SOCS6, SOGA2, SON, SORBS2, SORCS1, SORCS2, SOS2, SOX7, SPATA18, SPATA20, SPATA5, SPATS2, SPDYA, SPEF2, SPG20, SPIDR, SPINK5, SPRED2, SPRYD7, SQLE, SQRDL, SQSTM1, SRCAP, SREBF1, SREK1, SRGAP1, SRRM1, SRSF3, SSBP1, STAC2, STARD4, STAT1, STAT3, STAT4, STAU1, STC2, STEAP2, STK32B, STRAD8, STRIP1, STRN3, STRN4, STS, STX16, STXBP4, STXBP6, SULF1, SUPT20H, SVEP1, SYNE1, SYNE2, SYNGR2, SYNPO, SYNPO2, SYNPO2L, SYT15, SYTL2, TACC1, TAF2, TAGLN3, TANC2, TANGO6, TARBP1, TARS, TASP1, TBC1D15, TBCA, TBL1XR1, TBL2, TCF12, TCF4, TCF7L2, TEKT4P2, TENC1, TENM2, TEP1, TET1, TET3, TEX21P, TFCP2, TGFA, TGFB2, TGFB3, TGFB1, TGFBR1, TGFBRAP1, TGM2, THADA, THAP4, THBS2, THRB, TIAM1, TIMP2, TJAP1, TJP2, TLE3, TLK1, TMC3, TMEM67, TMEM102, TMEM119, TMEM134, TMEM154, TMEM189-UBE2V1, TMEM214, TMEM256-PLSCR3, TMEM47, TMEM50B, TMEM63A, TMX3, TNC, TNFAIP3, TNFAIP8L3, TNFRSF12A, TNFRSF14, TNIP1, TNKS1BP1, TNPO3, TNRC18P1, TNRC6A, TNS1, TNS3, TNXB, TOE1, TOMM40, TOMM5, TOPORS, TP53AIP1, TP53INP1, TPRG1, TRAF3, TRAK1, TRAPPC12, TRIB1, TRIM2, TRIM23, TRIM26, TRIM28, TRIM65, TRIM66, TRMT1L, TRPC4, TRPS1, TSC2, TSHZ1, TSHZ2, TSPAN11, TSPAN18, TSPAN2, TSPAN7, TSSK3, TTC7A, TTC7B, TUBB2C, TUBB3, TUBE1, TXNIP, TXNL1, TXNL4B, TXNRD1, TYW5, U2SURP, UBAP2L, UBE2D3, UBE2G2, UBE2L3, UBE2V1, UBN2, UBQLN4, UCHL5, UHMK1, UHRF1BP1L, UNC13B, UNC5B, URGCP, URGCP-MRPS24, USP19, USP7, USP27X, UVRAG, VANGL1, VARS2, VAV2, VCL, VDAC2, VIM-AS1, VIPAS39, VPS13A, VPS29, VPS41, VPS51, VSTM2L, VWA8, VWF, WDR19, WDR27, WDR37, WDR48, WDR90, WDR91, WHSC2, WIPF1, WISP1, WNK1, WNT5B, WNT10B, WSB1, WWTR1, XDH, XIAP, XRN2, YAP1, YDJC, YES1, YPEL5, YTHDF3, Z24749, ZAK, ZBTB10, ZBTB24, ZBTB26, ZBTB7A, ZC3H12C, ZC3H14, ZC3H18, ZCCHC5, ZCCHC8, ZCCHC11, ZEB1, ZEB2, ZFAND1, ZFAND5, ZFP82, ZHX3, ZMIZ1, ZMIZ1-AS1, ZMIZ2, ZMYM2, ZNF12, ZNF138, ZNF148, ZNF208, ZNF212, ZNF219, ZNF227, ZNF232, ZNF24, ZNF268, ZNF28, ZNF280D, ZNF281, ZNF335, ZNF350, ZNF37A, ZNF37BP, ZNF395, ZNF426, ZNF431, ZNF583, ZNF618, ZNF621, ZNF652, ZNF655, ZNF660, ZNF674, ZNF680, ZNF730, ZNF74, ZNF764, ZNF777, ZNF778, ZNF780A, ZNF7804A, ZNF79, ZNF827, ZNF836, ZNF837, ZNF839, ZNF91 and ZSCAN25.

In a particular aspect, provided herein is a method for modifying RNA splicing in order to modulate the amount of a mature mRNA transcript produced by a pre-mRNA transcript, the method comprising contacting a cell or cell lysate containing the pre-mRNA transcript with a compound of Formula (I) or a form thereof, wherein the pre-mRNA transcript comprises two exons and an intron, wherein a first exon is upstream of the intron and a second exon is downstream of the intron, wherein the intron comprises a RNA nucleotide sequence comprising in 5' to 3' order: an endogenous or non-endogenous intronic recognition element for splicing modifier (iREMS), a branch point, and a 3' splice site, wherein the iREMS comprises an RNA sequence GAgurngn, wherein r is adenine or guanine and n is any nucleotide, and wherein the pre-mRNA transcript is a pre-mRNA transcript of a gene that is selected from APOA2, ASAP1, BRCA1, BRCA2, CDKN1C, CRX, CTRC, DENND5A, DIAPH3, DMD, DNAH11, EIF2B3, GALC, HPS1, HTT, IKBKAP, KIAA1524, LMNA, MECP2, PAPD4, PAX6, PCCB, PITPNB, PTCH1, SLC34A3, SMN2, SPINK5, SREK1, TMEM67, VWF, XDH and XRN2.

In a particular aspect, provided herein is a method for modifying RNA splicing in order to modulate the amount of a mature mRNA transcript produced by a pre-mRNA transcript, the method comprising contacting a cell or cell lysate containing the pre-mRNA transcript with a compound of Formula (I) or a form thereof, wherein the pre-mRNA transcript comprises two exons and an intron, wherein a first exon is upstream of the intron and a second exon is downstream of the intron, wherein the intron comprises a RNA nucleotide sequence comprising in 5' to 3' order: an endogenous or non-endogenous intronic recognition element for splicing modifier (iREMS), a branch point, and a 3' splice site, wherein the iREMS comprises an RNA sequence GAgurngn, wherein r is adenine or guanine and n is any nucleotide, and wherein the pre-mRNA transcript is a pre-mRNA transcript of a gene that is selected from ABCA1, ABCA10, ABCB7, ABCB8, ABCC1, ABCC3, ABL2, ABLIM3, ACACA, ACADVL, ACAT2, ACTA2, ADAL, ADAM15, ADAM17, ADAM23, ADAM33, ADAMTS1, ADAMTS19, ADCY3, ADD1, ADGRG6, ADH6, ADHFE1, AFF2, AFF3, AGK, AGPAT3, AGPAT4, AGPS, AHCYL2, AHDC1, AHRR, AJUBA, AK021888, AK310472, AKAP1, AKAP3, AKAP8L, AKAP9, AKNA, ALCAM, ALDH4A1, AMPD2, ANK1, ANK2, ANK3, ANKFY1, ANKHD1-EIF4EBP3, ANKRA2, ANKRD13C, ANKRD17, ANKRD33B, ANKRD36, ANKS6, ANP32A, ANXA6, AP2B1, AP4B1-AS1, APAF1, APIP, APOA2, APP, APTX, ARHGAP1, ARHGAP12, ARHGAP22, ARHGAP5, ARHGEF16, ARID1A, ARID2, ARID5B, ARL9, ARL15, ARL5B, ARMCX3, ARSJ, ASAP1, ASIC1, ASL, ASNS, ASPH, ATAD2B, ATF6, ATF7IP, ATG9A, ATMIN, ATP2A3, ATP2C1, ATXN1, ATXN3, AURKA, B3GALT2, B3GNT6, B4GALT2, BACE1, BAG2, BASP1, BC033281, BCAR3, BCL2L15, BCYRN1, BECN1, BEND6, BHMT2, BICD1, BIN1, BIN3, BIN3-IT1, BIRC3, BIRC6, BNC1, BNC2, BRCA1, BRCA2, BRD2, BRPF1, BSCL2, BTBD10, BTG2, BTN3A1, BZW1, C1QTNF9B-AS1, C1orf27, C1orf86, C10orf54, C11orf30, C11orf70, C11orf73, C11orf76, C11orf94, C12orf4, C12orf56, C14orf132, C17orf76-AS1, C19orf47, C2orf47, C3, C4orf27, C5orf24, C6orf48, C7orf31, C8orf34, C8orf44, C8orf44-SGK3, C8orf8, C9orf69, CA13, CA3, CAB39, CACNA2D2, CACNB1, CACNB4, CADM1, CADM2, CALU, CAMKK1, CAND2, CAPNS1, CASC3, CASP7, CASP8AP2, CAV1, CCAR1, CCDC77, CCDC79, CCDC88A, CCDC92, CCDC122, CCER2, CCNF, CCNL2, CCT6A, CD276, CD46, CDC25B, CDC40, CDC42BPA, CDCA7, CDH11, CDH13, CDH18, CDK11B, CDK16, CDKAL1, CDKN1C, CECR7, CELSR1, CEMIP, CENPI, CEP112, CEP162, CEP170, CEP192, CEP68, CFH, CFLAR, CHD8, CHEK1, CHRM2, CIITA, CIZ1, CLDN23, CLIC1, CLK4, CLTA, CMAHP, CNGA4, CNOT1, CNRIP1, CNTD1, CMSS1, CNOT7, CNRIP1, CNTN1, COG1, COL1A1, COL11A1, COL12A1, COL14A1, COL15A1, COL5A1, COL5A3, COL6A1, COL6A6, COL8A1, COLEC12, COMP, COPS7B, CPA4, CPEB2, CPQ, CPSF4, CREB5, CRISPLD2, CRLF1, CRLS1, CRTAP, CRX, CRYBG3, CRYL1, CSDE1, CSNK1A1, CSNK1E, CSNK1G1, CTDSP2, CTNND1, CTRC, CUL2, CUL4A, CUX1, CYB5B, CYB5R2, CYBRD1, CYGB, CYP1B1, CYP51A1, DAAM1, DAB2, DACT1, DAGLB, DARS, DAXX, DCAF10, DCAF11, DCAF17, DCBLD2, DCLK1, DCN, DCUN1D4, DDAH1, DDAH2, DDHD2, DDIT4L, DDR1, DDX39B, DDX42, DDX50, DEGS1, DENND1A, DENND1B, DENND4A, DENND5A, DEPTOR, DET1, DFNB59, DGCR2, DGK1, DGKA, DHCR24, DHCR7, DHFR, DHX9, DIAPH1, DIAPH3, DIRAS3, DIS3L, DKFZp434M1735, DKK3, DLC1, DLG5, DMD, DMXL1, DNAH8, DNAH11, DNAJA4, DNAJC13, DNAJC27, DNM2, DNMBP, DOCK1, DOCK11, DPP8, DSEL, DST, DSTN, DYNC1I1, DYRK1A, DZIP1L, EBF1, EEA1, EEF1A1, EFCAB14, EFEMP1, EGR1, EGR3, EHMT2, EIF2B3, EIF4G1, EIF4G2, EIF4G3, ELF2, ELMO2, ELN, ELP4, EMX2OS, ENAH, ENG, ENOX1, ENPP1, ENPP2, ENSA, EP300, EPT1, ERC1, ERC2, ERCC1, ERCC8, ERLIN2, ERRFI1, ESM1, ETV5, EVC, EVC2, EXO1, EXOC3, EXOC6B, EXTL2, EYA3, F2R, FADS1, FADS2, FAF1, FAIM, FAM111A, FAM26A, FAM13A, FAM160A1, FAM162A, FAM174A, FAM195B, FAM198B, FAM20A, FAM208B, FAM219A, FAM219B, FAM3C, FAM46B, FAM49B, FAM65A, FAM65B, FAM69B, FAP, FARP1, FBLN2, FBN2, FBXL16, FBXL6, FBXO9, FBXO10, FBXO18, FBXO31, FBXO34, FBXO9, FCHO1, FDFT1, FDPS, FER, FEZ1, FGD4, FGD5-AS1, FGFR2, FGFRL1, FGL2, FHOD3, FLII, FLNB, FLT1, FN1, FNBP1, FOCAD, FOS, FOSB, FOSL1, FOXK1, FRAS1, FSCN2, FUS, FYN, GABPB1, GAL3ST4, GALC, GALNT1, GALNT15, GAS7, GATA6, GBA2, GBGT1, GBP1, GCFC2, GLCE, GCNT1, GDF6, GGACT, GHDC, GIGYF2, GJC1, GLCE, GMIP, GNA13, GNAQ, GNAS, GNG12, GNL3L, GOLGA2, GOLGA4, GOLGB1, GORASP1, GPR1, GPR183, GPR50, GPR89A, GPRC5A, GPRC5B, GPSM2, GREM1, GRK6, GRTP1, GSE1, GTF2H2B, GTSF1, GUCA1B, GULP1, GXYLT1, HAPLN1, HAPLN2, HAS2, HAS3, HAT1, HAUS3, HAUS6, HAVCR2, HDAC5, HDAC7, HDX, HECTD2-AS1, HEG1, HEPH, HEY1, HLA-A, HLA-E, HLTF, HMGA1, HMGA2, HMGB1, HMGCR, HMGN3-AS1, HMGCS1, HMGXB4, HOOK3, HOXB3, HMOX1, HNMT, HNRNPR, HNRNPUL1, HP1BP3, HPS1, HRH1, HSD17B12, HSPA1L, HTATIP2, HTT, IARS, IDH1, IDI1, IFT57, IGDCC4, IGF2BP2, IGF2R, IGFBP3, IKBKAP, IL16, IL6ST, INA, INHBA, INO80, IPP4B, INPP5K, INSIG1, INTU, INVS, IQCE, IQCG, ITCH, ITGAI1, ITGA8, ITGAV, ITGB5, ITGB8, ITIH1, ITM2C, ITPKA, ITSN1, IVD, KANSL3, KAT6B, KCNK2, KCNS1, KCNS2, KDM6A, KDSR, KIAA1033, KIAA1143, KIAA1199, KIAA1456, KIAA1462, KIAA1522, KIAA1524, KIAA1549, KIAA1715, KIAA1755, KIDINS220, KIF14, KIF2A, KIF21A, KIF3A, KIT, KLC1, KLC2, KLF17, KLF6, KLHL7, KLRG1, KMT2D, KRT7, KRT18, KRT19, KRT34, KRTAP1-1, KRTAP1-5, KRTAP2-3, L3MBTL2, LAMA2, LAMB1, LAMB2P1, LARP4, LATS2, LDLR, LEMD3, LETM2, LGALS3, LGALS8, LGI2, LGR4, LHX9, LIMS1, LINC00341, LINC00472, LINC00570, LINC00578, LINC00607, LINC00657, LINC00678, LINC00702, LINC00886, LINC00961, LINC01011, LINC01118, LINC01204, LINCR-0002, LINGO2, LMAN2L, LMNA, LMO7, LMOD1, LOC400927, LONP1, LOX, LPHN1, LRBA, LRCH4, LRIG1, LRP4, LRP8, LRRC1, LRRC32, LRRC39, LRRC8A, LSAMP, LSS, LTBR, LUC7L2, LUM, LYPD1, LYRM1, LZTS2, MACROD2, MAFB, MAGED4, MAGED4B, MAMDC2, MAN1A2, MAN2A1, MAN2C1, MANEA, MAP4K4, MAPK10, MAPK13, MARCH7, MARCH8, MASP1, MB, MB21D2, MBD1, MBOAT7, MC4R, MCM10, MDM2, MDN1, MEAF6, MECP2, MED1, MED13L, MEDAG, MEF2D, MEGF6, MEIS2, MEMO1, MEPCE, MFGE8, MFN2, MIAT, MICAL2, MINPP1, MIR612, MKL1, MKLN1, MKNK2, MLLT4, MLLT10, MLST8, MMAB, MMP10, MMP24, MMS19, MMS22L, MN1, MORF4L1, MOXD1, MPPE1, MPZL1, MRPL3, MRPL45, MRPL55, MRPS28, MRVI1, MSANTD3, MSC, MSH2, MSH4, MSH6, MSL3, MSMO1, MSRB3, MTAP, MTERF3, MTERFD1, MTHFD1L, MTMR3, MTMR9, MTRR, MUM1, MVD, MVK, MXRA5, MYADM, MYB, MYCBP2, MYLK, MYO1D, MYO9B, MYOF, NA, NAA35, NAALADL2, NADK, NAE1, NAGS, NASP, NAV1, NAV2, NCOA1, NCOA3, NCOA4, NCSTN, NDNF, NEDD4, NELFA, NEO1, NEURL1B, NF2, NFASC, NFE2L1, NFX1, NGF, NGFR, NHLH1, NID1, NID2, NIPA1, NKX3-1, NLGN1, NLN, NOL10, NOMO3, NOTCH3, NOTUM, NOVA2, NOX4, NPEPPS, NRD1, NREP, NRG1, NRROS, NSUN4, NT5C2, NT5E, NTNG1, NUDT4, NUP153, NUP35, NUP50, NUPL1, NUSAP1, OCLN, ODF2, OLR1, OS9, OSBPL3, OSBPL6, OSBPL10, OSMR, OXCT1, OXCT2, P4HA1, P4HB, PABPC1, PAIP2B, PAK4, PAPD4, PARD3, PARN, PARP14, PARP4, PARVB, PAX6, PBLD, PBX3, PCBP2, PCCB, PCDH10, PCDHGB3, PCGF3, PCM1, PCMTD2, PCNXL2, PCSK9, PDE1C, PDE3A, PDE4A, PDE5A, PDE7A, PDGFD, PDGFRB, PDLIM7, PDS5B, PDXDC1, PDXDC2P, PEARL PELI1, PEPD, PEX5, PFKP, PHACTR3, PHF19, PHF8, PHRF1, PHTF2, PI4K2A, PIEZO1, PIGN, PIGU, PIK3C2B, PIK3CD, PIK3R1, PIKFYVE, PIM2, PITPNA, PITPNB, PITPNM1, PITPNM3, PLAU, PLEC, PLEK2, PLEKHA1, PLEKHA6, PLEKHB2, PLEKHH2, PLSCR1, PLSCR3, PLXNB2, PLXNC1, PMS1, PNISR, PODN, POLE3, POLN, POLR1A, POLR3D, POMT2, POSTN, POU2F1, PPAPDC1A, PPARA, PPARG, PPFIBP1, PPIP5K1, PPIP5K2, PPM1E, PPP1R12A, PPPR26, PPP3CA, PPP6R1, PPP6R2, PRKCA, PRKDC, PRKG1, PRMT1, PRNP, PRPF31, PRPH2, PRRG4, PRSS23, PRUNE2, PSMA4, PSMC1, PSMD6, PSMD6-AS2, PTCH1, PTGIS, PTK2B, PTPN14, PTX3, PUF60, PUS7, PVR, PXK, PXN, QKI, RAB2B, RAB30, RAB34, RAB38, RAB44, RAD1, RAD9B, RAD23B, RAF1, RALB, RAP1GDS1, RAPGEF1, RARG, RARS, RARS2, RASIP1, RASSF8, RBBP8, RBCK1, RCOR3, RBFOX2, RBKS, RBM10, RDX, RERE, RFTN1, RFWD2, RFX3-AS1, RGCC, RGL1, RGS10, RGS3, RIF1, RNF14, RNF19A, RNF130, RNF144A, RNF213, RNF38, RNFT1, ROR1, ROR2, RPA1, RPF2, RPL10, RPS10, RPS6KB2, RPS6KC1, RRBP1, RWDD4, SAMD4A, SAMD9, SAMD9L, SAR1A, SART3, SCAF4, SCAF8, SCARNA9, SCD, SCLT1, SCO1, SDCBP, SEC14L1, SEC22A, SEC24A, SEC24B, SEC61A1, SENP6, SEPT9, SERGEF, SERPINE2, SF1, SF3B3, SGIP1, SGK3, SGMS1, SGOL2, SGPL1, SH2B3, SH3RF1, SH3YL1, SHROOM3, SIGLEC10, SKA2, SKIL, SKP1, SLC12A2, SLC24A3, SLC25A16, SLC25A17, SLC34A3, SLC35F3, SLC39A3, SLC39A10, SLC4A4, SLC4A11, SLC41A1, SLC44A2, SLC46A2, SLC6A15, SLC7A6, SLC7A8, SLC7A11, SLC9A3, SLIT3, SMARCA4, SMARCC2, SMC4, SMC6, SMCHD1, SMG1, SMG1P3, SMOX, SMPD4, SMTN, SMYD3, SMYD5, SNAP23, SNED1, SNHG16, SNX7, SNX14, SNX24, SNX7, SOCS2, SOCS6, SOGA2, SON, SORBS2, SORCS1, SORCS2, SOS2, SOX7, SPATA18, SPATA20, SPATA5, SPATS2, SPDYA, SPEF2, SPG20, SPIDR, SPINK5, SPRED2, SPRYD7, SQLE, SQRDL, SQSTM1, SRCAP, SREBF1, SRGAP1, SRRM1, SRSF3, SSBP1, STAC2, STARD4, STAT1, STAT3, STAT4, STAU1, STC2, STEAP2, STK32B, STRAD8, STRIP1, STRN4, STS, STX16, STXBP4, STXBP6, SULF1, SUPT20H, SVEP1, SYNE1, SYNE2, SYNGR2, SYNPO, SYNPO2, SYNPO2L, SYT15, SYTL2, TACC1, TAF2, TAGLN3, TANC2, TANGO6, TARBP1, TARS, TASP1, TBC1D15, TBCA, TBL1XR1, TBL2, TCF12, TCF4, TCF7L2, TEKT4P2, TENC1, TENM2, TEP1, TET1, TET3, TEX21P, TFCP2, TGFA, TGFB2, TGFB3, TGFB1, TGFBR1, TGFBRAP1, TGM2, THADA, THAP4, THBS2, THRB, TIAM1, TIMP2, TJAP1, TJP2, TLE3, TLK1, TMC3, TMEM67, TMEM102, TMEM119, TMEM134, TMEM154, TMEM189-UBE2V1, TMEM214, TMEM256-PLSCR3, TMEM47, TMEM50B, TMEM63A, TMX3, TNC, TNFAIP3, TNFAIP8L3, TNFRSF12A, TNFRSF14, TNIP1, TNKS1BP1, TNPO3, TNRC18P1, TNS1, TNS3, TNXB, TOE1, TOMM40, TOMM5, TOPORS, TP53AIP1, TP53INP1, TPRG1, TRAF3, TRAK1, TRAPPC12, TRIB1, TRIM2, TRIM23, TRIM26, TRIM28, TRIM65, TRIM66, TRMT1L, TRPC4, TRPS1, TSC2, TSHZ1, TSHZ2, TSPAN11, TSPAN18, TSPAN2, TSPAN7, TSSK3, TTC7A, TTC7B, TUBB2C, TUBB3, TUBE1, TXNIP, TXNL1, TXNL4B, TXNRD1, TYW5, U2SURP, UBAP2L, UBE2D3, UBE2G2, UBE2L3, UBE2V1, UBN2, UBQLN4, UCHL5, UHMK1, UHRF1BP1L, UNC13B, UNC5B, URGCP, URGCP-MRPS24, USP19, USP7, USP27X, UVRAG, VANGL1, VARS2, VAV2, VCL, VDAC2, VIM-AS1, VIPAS39, VPS13A, VPS29, VPS41, VPS51, VSTM2L, VWA8, VWF, WDR19, WDR27, WDR37, WDR48, WDR90, WDR91, WHSC2, WIPF1, WISP1, WNK1, WNT5B, WNT10B, WSB1, WWTR1, XDH, XIAP, XRN2, YAP1, YDJC, YES1, YPEL5, YTHDF3, Z24749, ZAK, ZBTB10, ZBTB24, ZBTB26, ZBTB7A, ZC3H12C, ZC3H14, ZC3H18, ZCCHC5, ZCCHC8, ZCCHC11, ZEB1, ZEB2, ZFAND1, ZFAND5, ZFP82, ZHX3, ZMIZ1, ZMIZ1-AS1, ZMIZ2, ZMYM2, ZNF12, ZNF138, ZNF148, ZNF208, ZNF212, ZNF219, ZNF227, ZNF232, ZNF24, ZNF268, ZNF28, ZNF280D, ZNF281, ZNF335, ZNF350, ZNF37A, ZNF37BP, ZNF395, ZNF426, ZNF431, ZNF583, ZNF618, ZNF621, ZNF652, ZNF655, ZNF660, ZNF674, ZNF680, ZNF730, ZNF74, ZNF764, ZNF777, ZNF778, ZNF780A, ZNF7804A, ZNF79, ZNF827, ZNF836, ZNF837, ZNF839, ZNF91 and ZSCAN25.

In a particular aspect, provided herein is a method for modifying RNA splicing in order to modulate the amount of a mature mRNA transcript produced by a pre-mRNA transcript, the method comprising contacting a cell or cell lysate containing the pre-mRNA transcript with a compound of Formula (I) or a form thereof, wherein the pre-mRNA transcript comprises two exons and an intron, wherein a first exon is upstream of the intron and a second exon is downstream of the intron, wherein the intron comprises a RNA nucleotide sequence comprising in 5' to 3' order: an endogenous or non-endogenous intronic recognition element for splicing modifier (iREMS), a branch point, and a 3' splice site, wherein the iREMS comprises an RNA sequence GAgurngn, wherein r is adenine or guanine and n is any nucleotide, and wherein the pre-mRNA transcript is a pre-mRNA transcript of a gene that is not SMN2.

In a particular aspect, provided herein is a method for modifying RNA splicing in order to modulate the amount of a mature mRNA transcript produced by a pre-mRNA transcript, the method comprising contacting a cell or cell lysate containing the pre-mRNA transcript with a compound of Formula (I) or a form thereof, wherein the pre-mRNA transcript comprises two exons and an intron, wherein a first exon is upstream of the intron and a second exon is downstream of the intron, wherein the intron comprises a RNA nucleotide sequence comprising in 5' to 3' order: an endogenous or non-endogenous intronic recognition element for splicing modifier (iREMS), a branch point, and a 3' splice site, wherein the iREMS comprises an RNA sequence GAgurngn, wherein r is adenine or guanine and n is any nucleotide, and wherein the pre-mRNA transcript is a pre-mRNA transcript of a gene that is not selected from ABHD10, ADAM12, AKT1, ANXA11, APLP2, APPL2, ARMCX6, ATG5, AXIN1, BAIAP2, CCNB1IP1, CCT7, CEP57, CSF1, DLGAP4, EPN1, ERGIC3, FOXM1, GGCT, GRAMD3, HSD17B4, LARP7, LRRC42, MADD, MAN1B1, MRPL39, PCBP4, PPHLN1, PRKACB, RAB23, RAP1A, RCC1, SREK1, STRN3 and TNRC6A.

In a particular aspect, provided herein is a method for modifying RNA splicing in order to modulate the amount of a mature mRNA transcript produced by a pre-mRNA transcript, the method comprising contacting a cell or cell lysate containing the pre-mRNA transcript with a compound of Formula (I) or a form thereof, wherein the pre-mRNA transcript comprises two exons and an intron, wherein a first exon is upstream of the intron and a second exon is downstream of the intron, wherein the intron comprises a RNA nucleotide sequence comprising in 5' to 3' order: an endogenous or non-endogenous intronic recognition element for splicing modifier (iREMS), a branch point, and a 3' splice site, wherein the iREMS comprises an RNA sequence GAgurngn, wherein r is adenine or guanine and n is any nucleotide, and wherein the pre-mRNA transcript is a pre-mRNA transcript of a gene that is not selected from ABHD10, ADAM12, AKT1, ANXA11, APLP2, APPL2, ARMCX6, ATG5, AXIN1, BAIAP2, CCNB1IP1, CCT7, CEP57, CSF1, DLGAP4, EPN1, ERGIC3, FOXM1, GGCT, GRAMD3, HSD17B4, LARP7, LRRC42, MADD, MAN1B1, MRPL39, PCBP4, PPHLN1, PRKACB, RAB23, RAP1A, RCC1, SMN2, SREK1, STRN3 and TNRC6A.

In certain aspects, the cell(s) contacted or cultured with a compound of Formula (I) or a form thereof is primary cell(s) or cell(s) from a cell line. In some aspects, the cell(s) contacted or cultured with a compound of Formula (I) or a form thereof is a fibroblast(s), an immune cell(s), or a muscle cell(s). In some embodiments, the cell(s) contacted or cultured with a compound of Formula (I) or a form thereof is a cancer cell. Non-limiting examples of cell lines include 3T3, 4T1, 721, 9L, A2780, A172, A20, A253, A431, A-549, ALC, B16, B35, BCP-1, BEAS-2B, bEnd.3, BHK, BR 293, BT20, BT483, BxPC3, C2C12, C3H-10T1/2, C6/36, C6, Cal-27, CHO, COR-L23, COS, COV-434, CML T1, CMT, CRL7030, CT26, D17, DH82, DU145, DuCaP, EL4, EM2, EM3, EMT6, FM3, H1299, H69, HB54, HB55, HCA2, HD-1994, HDF, HEK-293, HeLa, Hepa1c1c7, HL-60, HMEC, Hs578T, HsS78Bst, HT-29, HTB2, HUVEC, Jurkat, J558L, JY, K562, Ku812, KCL22, KG1, KYO1, LNCap, Ma-Mel, MC-38, MCF-7, MCF-10A, MDA-MB-231, MDA-MB-468, MDA-MB-435, MDCK, MG63, MOR/0.2R, MONO-MAC 6, MRC5, MTD-1A, NCI-H69, NIH-3T3, NALM-1, NSO, NW-145, OPCN, OPCT, PNT-1A, PNT-2, Raji, RBL, RenCa, RIN-5F, RMA, Saos-2, Sf21, Sf9, SH-SY5Y, SiHa, SKBR3, SKOV-3, T2, T-47D, T84, THP1, U373, U87, U937, VCaP, Vero, VERY, W138, WM39, WT-49, X63, YAC-1, and YAR cells. In one aspect, the cells are from a patient. In another aspect, the patient cells are GM03813 cells. In another aspect, the patient cells are GM04856, GM04857, GM09197, GM04281, GM04022, GM07492 cells.

In certain aspects described herein, the cell(s) is contacted or cultured with a compound of Formula (I) or a form thereof with a compound of Formula (I) or a form thereof for a period of 15 minutes, 30 minutes, 45 minutes, 1 hour, 2 hours, 3 hours, 4 hours, 5 hours, 6 hours, 8 hours, 12 hours, 18 hours, 24 hours, 48 hours, 72 hours or more. In other aspects described herein, the cell(s) is contacted or cultured with a compound of Formula (I) or a form thereof with a compound of Formula (I) or a form thereof for a period of 15 minutes to 1 hour, 1 to 2 hours, 2 to 4 hours, 6 to 12 hours, 12 to 18 hours, 12 to 24 hours, 28 to 24 hours, 24 to 48 hours, 48 to 72 hours.

In certain aspects described herein, the cell(s) is contacted or cultured with a certain concentration of a compound of Formula (I) or a form thereof, wherein the certain concentration is 0.01 µM, 0.05 µM, 1 µM, 2 µM, 5 µM, 10 µM, 15 µM, 20 µM, 25 µM, 50 µM, 75 µM, 100 µM, or 150 µM. In other aspects described herein, the cell(s) is contacted or cultured with a certain concentration of a compound of Formula (I) or a form thereof, wherein the certain concentration is 175 µM, 200 µM, 250 µM, 275 µM, 300 µM, 350 µM, 400 µM, 450 µM, 500 µM, 550 µM, 600 µM, 650 µM, 700 µM, 750 µM, 800 µM, 850 µM, 900 µM, 950 µM or 1 mM. In some aspects described herein, the cell(s) is contacted or cultured with a certain concentration of a compound of Formula (I) or a form thereof, wherein the certain concentration is 5 nM, 10 nM, 20 nM, 30 nM, 40 nM, 50 nM, 60 nM, 70 nM, 80 nM, 90 nM, 100 nM, 150 nM, 200 nM, 250 nM, 300 nM, 350 nM, 400 nM, 450 nM, 500 nM, 550 nM, 600 nM, 650 nM, 700 nM, 750 nM, 800 nM, 850 nM, 900 nM, or 950 nM. In certain aspects described herein, the cell(s) is contacted or cultured with a certain concentration of a compound of Formula (I) or a form thereof, wherein the certain concentration is between 0.01 µM to 0.1 µM, 0.1 µM to 1 µM, 1 µM to 50 µM, 50 µM to 100 µM, 100 µM to 500 µM, 500 µM to 1 nM, 1 nM to 10 nM, 10 nM to 50 nM, 50 nM to 100 nM, 100 nM to 500 nM, 500 nM to 1000 nM. In certain aspects described herein, the cell(s) is contacted or cultured with a certain concentration of a compound of Formula (I) or a form thereof that results in a substantial change in the amount of an RNA transcript (e.g., an mRNA transcript), an alternatively spliced variant, or an isoform of a gene (e.g., a gene described herein, infra).

In another aspect, provided herein are methods for modifying RNA splicing in order to modulate the amount of one, two, three or more RNA transcripts of a gene, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In a specific aspect, the precursor RNA transcript contains in 5' to 3' order: a branch point, a 3' splice site and an intronic REMS. In another specific aspect, the precursor RNA transcript contains in 5' to 3' order: a first 5' splice site, a first branch point, a first 3' splice site, an intronic REMS, a second branch point, and a second 3' splice site. In another specific aspect the precursor RNA transcript contains in 5' to 3' order: an intronic REMS, a branch point, and a 3' splice site.

In one aspect, provided herein are methods for modifying RNA splicing in order to modulate the amount of one, two, three or more RNA transcripts of a gene described herein, the methods comprising administering to a human or non-human subject a compound of Formula (I) or a form thereof, or a pharmaceutical composition comprising a compound of Formula (I) or a form thereof and a pharmaceutically acceptable carrier, excipient or diluent.

In another aspect, provided herein are methods for modifying RNA splicing in order to modulate the amount of one, two, three or more RNA transcripts of a gene described herein, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In a specific aspect, the precursor RNA transcript contains in 5' to 3' order: a branch point, a 3' splice site and an intronic REMS. In another specific aspect, the precursor RNA transcript contains in 5' to 3' order: a first 5' splice site, a first branch point, a first 3' splice site, an intronic REMS, a second branch point, and a second 3' splice site. In another specific aspect the precursor RNA transcript contains in 5' to 3' order: an intronic REMS, a branch point, and a 3' splice site.

In a particular aspect, provided herein are methods for modifying RNA splicing in order to modulate the amount of one, two, three or more RNA transcripts of a gene in a subject, wherein the precursor RNA transcript transcribed from the gene comprises an intronic REMS (for example, an endogenous intronic REMS or a non-endogenous intronic REMS), the methods comprising administering to the subject a compound of Formula (I) or a form thereof, or a pharmaceutical composition comprising a compound of Formula (I) or a form thereof and a pharmaceutically acceptable carrier, excipient or diluent, and wherein the gene is selected from ABCA1, ABCA10, ABCB7, ABCB8, ABCC1, ABCC3, ABHD10, ABL2, ABLIM3, ACACA, ACADVL, ACAT2, ACTA2, ADAL, ADAM12, ADAM15, ADAM17, ADAM23, ADAM33, ADAMTS1, ADAMTS19, ADCY3, ADD1, ADGRG6, ADH6, ADHFE1, AFF2, AFF3, AGK, AGPAT3, AGPAT4, AGPS, AHCYL2, AHDC1, AHRR, AJUBA, AK021888, AK310472, AKAP1, AKAP3, AKAP8L, AKAP9, AKNA, AKT1, ALCAM, ALDH4A1, AMPD2, ANK1, ANK2, ANK3, ANKFY1, ANKHD1-EIF4EBP3, ANKRA2, ANKRD13C, ANKRD17, ANKRD33B, ANKRD36, ANKS6, ANP32A, ANXA11, ANXA6, AP2B1, AP4B1-AS1, APAF1, APIP, APLP2, APOA2, APP, APPL2, APTX, ARHGAP1, ARHGAP12, ARHGAP22, ARHGAP5, ARHGEF16, ARID1A, ARID2, ARID5B, ARL9, ARL15, ARL5B, ARMCX3, ARMCX6, ARSJ, ASAP1, ASIC1, ASL, ASNS, ASPH, ATAD2B, ATF6, ATF7IP, ATG5, ATG9A, ATMIN, ATP2A3, ATP2C1, ATXN1, ATXN3, AURKA, AXIN1, B3GALT2, B3GNT6, B4GALT2, BACE1, BAG2, BASP1, BC033281, BCAR3, BCL2L15, BCYRN1, BECN1, BEND6, BHMT2, BICD1, BIN1, BIN3, BIN3-IT1, BIRC3, BIRC6, BNC1, BNC2, BRCA1, BRCA2, BRD2, BRPF1, BSCL2, BTBD10, BTG2, BTN3A1, BZW1, C1QTNF9B-AS1, C1orf27, C1orf86, C10orf54, C11orf30, C11orf70, C11orf73, C11orf76, C11orf94, C12orf4, C12orf56, C14orf132, C17orf76-AS1, C19orf47, C2orf47, C3, C4orf27, C5orf24, C6orf48, C7orf31, C8orf34, C8orf44, C8orf44-SGK3, C8orf88, C9orf69, CA13, CA3, CAB39, CACNA2D2, CACNB1, CACNB4, CADM1, CADM2, CALU, CAMKK1, CAND2, CAPNS1, CASC3, CASP7, CASP8AP2, CAV1, CCAR1, CCDC77, CCDC79, CCDC88A, CCDC92, CCDC122, CCER2, CCNF, CCNL2, CCT6A, CD276, CD46, CDC25B, CDC40, CDC42BPA, CDCA7, CDH11, CDH13, CDH18, CDK11B, CDK16, CDKAL1, CDKN1C, CECR7, CELSR1, CEMIP, CENPI, CEP112, CEP162, CEP170, CEP192, CEP57, CEP68, CFH, CFLAR, CHD8, CHEK1, CHRM2, CIITA, CIZ1, CLDN23, CLIC1, CLK4, CLTA, CMAHP, CNGA4, CNOT1, CNRIP1, CNTD1, CMSS1, CNOT7, CNRIP1, CNTN1, COG1, COL1A1, COL11A1, COL12A1, COL14A1, COL15A1, COL5A1, COL5A3, COL6A1, COL6A6, COL8A1, COLEC12, COMP, COPS7B, CPA4, CPEB2, CPQ, CPSF4, CREB5, CRISPLD2, CRLF1, CRLS1, CRTAP, CRX, CRYBG3, CRYL1, CSDE1, CSNK1A1, CSNK1E, CSNK1G1, CTDSP2, CTNND1, CTRC, CUL2, CUL4A, CUX1, CYB5B, CYB5R2, CYBRD1, CYGB, CYP1B1, CYP51A1, DAAM1, DAB2, DACT1, DAGLB, DARS, DAXX, DCAF10, DCAF11, DCAF17, DCBLD2, DCLK1, DCN, DCUN1D4, DDAH1, DDAH2, DDHD2, DDIT4L, DDR1, DDX39B, DDX42, DDX50, DEGS1, DENND1A, DENND1B, DENND4A, DENND5A, DEPTOR, DET1, DFNB59, DGCR2, DGK1, DGKA, DHCR24, DHCR7, DHFR, DHX9, DIAPH1, DIAPH3, DIRAS3, DIS3L, DKFZp434M1735, DKK3, DLC1, DLG5, DLGAP4, DMD, DMXL1, DNAH8, DNAH11, DNAJA4, DNAJC13, DNAJC27, DNM2, DNMBP, DOCK1, DOCK11, DPP8, DSEL, DST, DSTN, DYNC1I1, DYRK1A, DZIP1L, EBF1, EEA1, EEFIA1, EFCAB14, EFEMP1, EGR1, EGR3, EHMT2, EIF2B3, EIF4G1, EIF4G2, EIF4G3, ELF2, ELMO2, ELN, ELP4, EMX2OS, ENAH, ENG, ENOX1, ENPP1, ENPP2, ENSA, EP300, EPN1, EPT1, ERC1, ERC2, ERCC1, ERCC8, ERGIC3, ERLIN2, ERRFI1, ESM1, ETV5, EVC, EVC2, EXO1, EXOC3, EXOC6B, EXTL2, EYA3, F2R, FADS1, FADS2, FAF1, FAIM, FAM111A, FAM126A, FAM13A, FAM160A1, FAM162A, FAM174A, FAM195B, FAM198B, FAM20A, FAM208B, FAM219A, FAM219B, FAM3C, FAM46B, FAM49B, FAM65A, FAM65B, FAM69B, FAP, FARP1, FBLN2, FBN2, FBXL16, FBXL6, FBXO9, FBXO10, FBXO18, FBXO31, FBXO34, FBXO9, FCHO1, FDFT1, FDPS, FER, FEZ1, FGD4, FGD5-AS1, FGFR2, FGFRL1, FGL2, FHOD3, FLII, FLNB, FLT1, FN1, FNBP1, FOCAD, FOS, FOSB, FOSL1, FOXK1, FOXM1, FRAS1, FSCN2, FUS, FYN, GABPB1, GAL3ST4, GALC, GALNT1, GALNT15, GAS7, GATA6, GBA2, GBGT1, GBP1, GCFC2, GLCE, GCNT1, GDF6, GGACT, GGCT, GHDC, GIGYF2, GJC1, GLCE, GMIP, GNA13, GNAQ, GNAS, GNG12, GNL3L, GOLGA2, GOLGA4, GOLGB1, GORASP1, GPR1, GPR183, GPR50, GPR89A, GPRC5A, GPRC5B, GPSM2, GREM1, GRK6, GRTP1, GSE1, GTF2H2B, GTSF1, GUCA1B, GULP1, GXYLT1, HAPLN1, HAPLN2, HAS2, HAS3, HAT1, HAUS3, HAUS6, HAVCR2, HDAC5, HDAC7, HDX, HECTD2-AS1, HEG1, HEPH, HEY1, HLA-A, HLA-E, HLTF, HMGA1, HMGA2, HMGB1, HMGCR, HMGN3-AS1, HMGCS1, HMGXB4, HOOK3, HOXB3, HMOX1, HNMT, HNRNPR, HNRNPUL1, HP1BP3, HPS1, HRH1, HSD17B12, HSD17B4, HSPA1L, HTATIP2, HTT, IARS, IDH1, IDI1, IFT57, IGDCC4, IGF2BP2, IGF2R, IGFBP3, IKBKAP, IL16, IL6ST, INA, INHBA, INO80, IPP4B, INPP5K, INSIG1, INTU, INVS, IQCE, IQCG, ITCH, ITGA11, ITGA8, ITGAV, ITGB5, ITGB8, ITIH1, ITM2C, ITPKA, ITSN1, IVD, KANSL3, KAT6B, KCNK2, KCNS1, KCNS2, KDM6A, KDSR, KIAA1033, KIAA1143, KIAA1199, KIAA1456, KIAA1462, KIAA1522, KIAA1524, KIAA1549, KIAA1715, KIAA1755, KIDINS220, KIF14, KIF2A, KIF21A, KIF3A, KIT, KLC1, KLC2, KLF17, KLF6, KLHL7, KLRG1, KMT2D, KRT7, KRT18, KRT19, KRT34, KRTAP1-1, KRTAP1-5, KRTAP2-3, L3MBTL2, LAMA2, LAMB1, LAMB2P1, LARP4, LARP7, LATS2, LDLR, LEMD3, LETM2, LGALS3, LGALS8, LGI2, LGR4, LHX9, LIMS1, LINC00341, LINC00472, LINC00570, LINC00578, LINC00607, LINC00657, LINC00678, LINC00702, LINC00886, LINC00961, LINC01011, LINC01118, LINC01204, LINCR-0002, LINGO2, LMAN2L, LMNA, LMO7, LMOD1, LOC400927, LONP1, LOX, LPHN1, LRBA, LRCH4, LRIG1, LRP4, LRP8, LRRC1, LRRC32, LRRC39, LRRC42, LRRC8A, LSAMP, LSS, LTBR, LUC7L2, LUM, LYPD1, LYRM1, LZTS2, MACROD2, MADD, MAFB, MAGED4, MAGED4B, MAMDC2, MAN1A2, MAN2A1, MAN2C1, MANEA, MAP4K4, MAPK10, MAPK13, MARCH7, MARCH8, MASP1, MB, MB21D2, MBD1, MBOAT7, MC4R, MCM10, MDM2, MDN1, MEAF6, MECP2, MED1, MED13L, MEDAG, MEF2D, MEGF6, MEIS2, MEMO1, MEPCE, MFGE8, MFN2, MIAT, MICAL2, MINPP1, MIR612, MKL1, MKLN1, MKNK2, MLLT4, MLLT10, MLST8, MMAB, MMP10, MMP24, MMS19, MMS22L, MN1, MORF4L1, MOXD1, MPPE1, MPZL1, MRPL3, MRPL39, MRPL45, MRPL55, MRPS28, MRVI1, MSANTD3, MSC, MSH2, MSH4, MSH6, MSL3, MSMO1, MSRB3, MTAP, MTERF3, MTERFD1, MTHFD1L, MTMR3, MTMR9, MTRR, MUM1, MVD, MVK, MXRA5, MYADM, MYB, MYCBP2, MYLK, MYO1D, MYO9B, MYOF, NA, NAA35, NAALADL2, NADK, NAE1, NAGS, NASP, NAV1, NAV2, NCOA1, NCOA3, NCOA4, NCSTN, NDNF, NEDD4, NELFA, NEO1, NEURL1B, NF2, NFASC, NFE2L1, NFX1, NGF, NGFR, NHLH1, NID1, NID2, NIPA1, NKX3-1, NLGN1, NLN, NOL10, NOMO3, NOTCH3, NOTUM, NOVA2, NOX4, NPEPPS, NRD1, NREP, NRG1, NRROS, NSUN4, NT5C2, NT5E, NTNG1, NUDT4, NUP153, NUP35, NUP50, NUPL1, NUSAP1, OCLN, ODF2, OLR1, OS9, OSBPL3, OSBPL6, OSBPL10, OSMR, OXCT1, OXCT2, P4HA1, P4HB, PABPC1, PAIP2B, PAK4, PAPD4, PARD3, PARN, PARP14, PARP4, PARVB, PAX6, PBLD, PBX3, PCBP2, PCBP4, PCCB, PCDH10, PCDHGB3, PCGF3, PCM1, PCMTD2, PCNXL2, PCSK9, PDE1C, PDE3A, PDE4A, PDE5A, PDE7A, PDGFD, PDGFRB, PDLIM7, PDS5B, PDXDC1, PDXDC2P, PEAR1, PELI1, PEPD, PEX5, PFKP, PHACTR3, PHF19, PHF8, PHRF1, PHTF2, PI4K2A, PIEZO1, PIGN, PIGU, PIK3C2B, PIK3CD, PIK3R1, PIKFYVE, PIM2, PITPNA, PITPNB, PITPNM1, PITPNM3, PLAU, PLEC, PLEK2, PLEKHA1, PLEKHA6, PLEKHB2, PLEKHH2, PLSCR1, PLSCR3, PLXNB2, PLXNC1, PMS1, PNISR, PODN, POLE3, POLN, POLR1A, POLR3D, POMT2, POSTN, POU2F1, PPAPDC1A, PPARA, PPARG, PPFIBP1, PPHLN1, PPIP5K1, PPIP5K2, PPM1E, PPP1R12A, PPP1R26, PPP3CA, PPP6R1, PPP6R2, PRKACB, PRKCA, PRKDC, PRKG1, PRMT1, PRNP, PRPF31, PRPH2, PRRG4, PRSS23, PRUNE2, PSMA4, PSMC1, PSMD6, PSMD6-AS2, PTCH1, PTGIS, PTK2B, PTPN14, PTX3, PUF60, PUS7, PVR, PXK, PXN, QKI, RAB23, RAB2B, RAB30, RAB34, RAB38, RAB44, RAD1, RAD9B, RAD23B, RAF1, RALB, RAP1A, RAP1GDS1, RAPGEF1, RARG, RARS, RARS2, RASIP1, RASSF8, RBBP8, RBCK1, RCOR3, RBFOX2, RBKS, RBM10, RCC1, RDX, RERE, RFTN1, RFWD2, RFX3-AS1, RGCC, RGL1, RGS10, RGS3, RIF1, RNF14, RNF19A, RNF130, RNF144A, RNF213, RNF38, RNFT1, ROR1, ROR2, RPA1, RPF2, RPL10, RPS10, RPS6KB2, RPS6KC1, RRBP1, RWDD4, SAMD4A, SAMD9, SAMD9L, SAR1A, SART3, SCAF4, SCAF8, SCARNA9, SCD, SCLT1, SCO1, SDCBP, SEC14L1, SEC22A, SEC24A, SEC24B, SEC61A1, SENP6, SEPT9, SERGEF, SERPINE2, SF1, SF3B3, SGIP1, SGK3, SGMS1, SGOL2, SGPL1, SH2B3, SH3RF1, SH3YL1, SHROOM3, SIGLEC10, SKA2, SKIL, SKP1, SLC12A2, SLC24A3, SLC25A16, SLC25A17, SLC34A3, SLC35F3, SLC39A3, SLC39A10, SLC4A4, SLC4A11, SLC41A1, SLC44A2, SLC46A2, SLC6A15, SLC7A6, SLC7A8, SLC7A11, SLC9A3, SLIT3, SMARCA4, SMARCC2, SMC4, SMC6, SMCHD1, SMG1, SMG1P3, SMN2, SMOX, SMPD4, SMTN, SMYD3, SMYD5, SNAP23, SNED1, SNHG16, SNX7, SNX14, SNX24, SNX7, SOCS2, SOCS6, SOGA2, SON, SORBS2, SORCS1, SORCS2, SOS2, SOX7, SPATA18, SPATA20, SPATA5, SPATS2, SPDYA, SPEF2, SPG20, SPIDR, SPINK5, SPRED2, SPRYD7, SQLE, SQRDL, SQSTM1, SRCAP, SREBF1, SREK1, SRGAP1, SRRM1, SRSF3, SSBP1, STAC2, STARD4, STAT1, STAT3, STAT4, STAU1, STC2, STEAP2, STK32B, STRAD8, STRIP1, STRN3, STRN4, STS, STX16, STXBP4, STXBP6, SULF1, SUPT20H, SVEP1, SYNE1, SYNE2, SYNGR2, SYNPO, SYNPO2, SYNPO2L, SYT15, SYTL2, TACC1, TAF2, TAGLN3, TANC2, TANGO6, TARBP1, TARS, TASP1, TBC1D15, TBCA, TBL1XR1, TBL2, TCF12, TCF4, TCF7L2, TEKT4P2, TENC1, TENM2, TEP1, TET1, TET3, TEX21P, TFCP2, TGFA, TGFB2, TGFB3, TGFB1, TGFBR1, TGFBRAP1, TGM2, THADA, THAP4, THBS2, THRB, TIAM1, TIMP2, TJAP1, TJP2, TLE3, TLK1, TMC3, TMEM67, TMEM102, TMEM119, TMEM134, TMEM154, TMEM189-UBE2V1, TMEM214, TMEM256-PLSCR3, TMEM47, TMEM50B, TMEM63A, TMX3, TNC, TNFAIP3, TNFAIP8L3, TNFRSF12A, TNFRSF14, TNIP1, TNKS1BP1, TNPO3, TNRC18P1, TNRC6A, TNS1, TNS3, TNXB, TOE1, TOMM40, TOMM5, TOPORS, TP53AIP1, TP53INP1, TPRG1, TRAF3, TRAK1, TRAPPC12, TRIB1, TRIM2, TRIM23, TRIM26, TRIM28, TRIM65, TRIM66, TRMT1L, TRPC4, TRPS1, TSC2, TSHZ1, TSHZ2, TSPAN11, TSPAN18, TSPAN2, TSPAN7, TSSK3, TTC7A, TTC7B, TUBB2C, TUBB3, TUBE1, TXNIP, TXNL1, TXNL4B, TXNRD1, TYW5, U2SURP, UBAP2L, UBE2D3, UBE2G2, UBE2L3, UBE2V1, UBN2, UBQLN4, UCHL5, UHMK1, UHRF1BP1L, UNC13B, UNC5B, URGCP, URGCP-MRPS24, USP19, USP7, USP27X, UVRAG, VANGL1, VARS2, VAV2, VCL, VDAC2, VIM-AS1, VIPAS39, VPS13A, VPS29, VPS41, VPS51, VSTM2L, VWA8, VWF, WDR19, WDR27, WDR37, WDR48, WDR90, WDR91, WHSC2, WIPF1, WISP1, WNK1, WNT5B, WNT10B, WSB1, WWTR1, XDH, XIAP, XRN2, YAP1, YDJC, YES1, YPEL5, YTHDF3, Z24749, ZAK, ZBTB10, ZBTB24, ZBTB26, ZBTB7A, ZC3H12C, ZC3H14, ZC3H18, ZCCHC5, ZCCHC8, ZCCHC11, ZEB1, ZEB2, ZFAND1, ZFAND5, ZFP82, ZHX3, ZMIZ1, ZMIZ1-AS1, ZMIZ2, ZMYM2, ZNF12, ZNF138, ZNF148, ZNF208, ZNF212, ZNF219, ZNF227, ZNF232, ZNF24, ZNF268, ZNF28, ZNF280D, ZNF281, ZNF335, ZNF350, ZNF37A, ZNF37BP, ZNF395, ZNF426, ZNF431, ZNF583, ZNF618, ZNF621, ZNF652, ZNF655, ZNF660, ZNF674, ZNF680, ZNF730, ZNF74, ZNF764, ZNF777, ZNF778, ZNF780A, ZNF7804A, ZNF79, ZNF827, ZNF836, ZNF837, ZNF839, ZNF91 and ZSCAN25.

In a specific aspect of the foregoing, the precursor RNA transcript contains in 5' to 3' order: a branch point, a 3' splice site and an intronic REMS. In another specific aspect of the foregoing, the precursor RNA transcript contains in 5' to 3' order: a first 5' splice site, a first branch point, a first 3' splice site, an intronic REMS, a second branch point, and a second 3' splice site. In another specific aspect of the foregoing, the precursor RNA transcript contains in 5' to 3' order: an intronic REMS, a branch point, and a 3' splice site.

In another specific aspect of the foregoing, the gene is selected from ABCA1, ABCA10, ABCB7, ABCB8, ABCC1, ABCC3, ABHD10, ABL2, ABLIM3, ACACA, ACADVL, ACAT2, ACTA2, ADAL, ADAM12, ADAM15, ADAM17, ADAM33, ADAMTS1, ADCY3, ADD1, ADGRG6, ADH6, ADHFE1, AFF2, AFF3, AGK, AGPAT3, AGPAT4, AGPS, AHCYL2, AHDC1, AHRR, AJUBA, AK021888, AK310472, AKAP1, AKAP3, AKAP9, AKNA, ALCAM, ALDH4A1, AMPD2, ANK1, ANK2, ANK3, ANKFY1, ANKHD1-EIF4EBP3, ANKRA2, ANKRD17, ANKRD33B, ANKRD36, ANKS6, ANP32A, ANXA11, ANXA6, AP2B1, AP4B1-AS1, APAF1, APIP, APLP2, APP, APPL2, APTX, ARHGAP1, ARHGAP12, ARHGAP22, ARHGEF16, ARID1A, ARID2, ARID5B, ARL9, ARL15, ARMCX3, ARMCX6, ASAP1, ASIC1, ASL, ASNS, ASPH, ATAD2B, ATF7IP, ATG5, ATG9A, ATMIN, ATP2A3, ATP2C1, ATXN1, ATXN3, AURKA, AXIN1, B3GALT2, B3GNT6, B4GALT2, BACE1, BAG2, BASP1, BC033281, BCAR3, BCL2L15, BCYRN1, BECN1, BEND6, BHMT2, BICD1, BIN1, BIN3-IT1, BIRC3, BIRC6, BNC1, BRD2, BRPF1, BSCL2, BTBD10, BTG2, BTN3A1, BZW1, C1orf86, C10orf54, C11orf30, C11orf70, C11orf73, C11orf94, C12orf4, C12orf56, C14orf132, C17orf76-AS1, C19orf47, C3, C4orf27, C5orf24, C6orf48, C7orf31, C8orf34, C8orf44, C8orf44-SGK3, C8orf88, C9orf69, CA13, CA3, CAB39, CACNA2D2, CACNB1, CADM1, CALU, CAMKK1, CAND2, CAPNS1, CASC3, CASP7, CASP8AP2, CAV1, CCAR1, CCDC77, CCDC79, CCDC88A, CCDC92, CCDC122, CCER2, CCNF, CCT6A, CD276, CD46, CDC25B, CDC40, CDC42BPA, CDCA7, CDH11, CDH13, CDK11B, CDK16, CDKAL1, CECR7, CELSR1, CEMIP, CENPI, CEP112, CEP170, CEP192, CEP68, CFH, CFLAR, CHD8, CHEK1, CIITA, CIZ1, CLDN23, CLIC1, CLK4, CLTA, CMAHP, CNGA4, CNOT1, CNRIP1, CNTD1, COG1, COL1A1, COL11A1, COL12A1, COL14A1, COL15A1, COL5A1, COL5A3, COL6A1, COL6A6, COL8A1, COLEC12, COMP, COPS7B, CPA4, CPEB2, CPQ, CPSF4, CREB5, CRISPLD2, CRLF1, CRLS1, CRTAP, CRYBG3, CRYL1, CSDE1, CSNK1A1, CSNK1E, CSNK1G1, CTDSP2, CTNND1, CUL2, CUL4A, CUX1, CYB5B, CYB5R2, CYBRD1, CYGB, CYP1B1, CYP51A1, DAB2, DACT1, DAGLB, DARS, DAXX, DCAF10, DCAF11, DCAF17, DCBLD2, DCLK1, DCN, DCUN1D4, DDAH1, DDAH2, DDHD2, DDIT4L, DDR1, DDX39B, DDX42, DDX50, DEGS1, DENND1A, DENND1B, DENND5A, DEPTOR, DFNB59, DGCR2, DGKA, DHCR24, DHCR7, DHFR, DHX9, DIAPH1, DIAPH3, DIRAS3, DIS3L, DKFZp434M1735, DKK3, DLC1, DLG5, DLGAP4, DNAH8, DNAJC13, DNAJC27, DNM2, DNMBP, DOCK1, DOCK11, DPP8, DSEL, DST, DSTN, DYNC1I1, DYRK1A, DZIP1L, EBF1, EEA1, EEFIA1, EFCAB14, EFEMP1, EGR1, EGR3, EHMT2, EIF2B3, EIF4G1, EIF4G2, EIF4G3, ELF2, ELN, ELP4, EMX2OS, ENAH, ENG, ENPP1, ENPP2, ENSA, EP300, EPN1, EPT1, ERC1, ERCC1, ERCC8, ERGIC3, ERLIN2, ERRFI1, ESM1, ETV5, EVC, EVC2, EXO1, EXTL2, EYA3, F2R, FADS1, FADS2, FAF1, FAIM, FAM111A, FAM126A, FAM13A, FAM160A1, FAM162A, FAM174A, FAM198B, FAM20A, FAM219A, FAM219B, FAM3C, FAM46B, FAM65A, FAM65B, FAP, FARP1, FBLN2, FBN2, FBXO9, FBXL6, FBXO10, FBXO18, FBXO31, FBXO34, FBXO9, FCHO1, FDFT1, FDPS, FER, FEZ1, FGD5-AS1, FGFR2, FGFRL1, FGL2, FHOD3, FLII, FLNB, FLT1, FN1, FNBP1, FOCAD, FOS, FOSB, FOSL1, FOXK1, FOXM1, FRAS1, FSCN2, FUS, FYN, GABPB1, GAL3ST4, GALC, GALNT1, GALNT15, GAS7, GATA6, GBA2, GBGT1, GCFC2, GCNT1, GDF6, GGACT, GGCT, GHDC, GIGYF2, GJC1, GLCE, GMIP, GNA13, GNAQ, GNAS, GNL3L, GOLGA2, GOLGA4, GOLGB1, GORASP1, GPR1, GPR183, GPR50, GPR89A, GPRC5A, GPRC5B, GPSM2, GREM1, GRK6, GRTP1, GSE1, GTF2H2B, GUCA1B, GULP1, GXYLT1, HAPLN1, HAPLN2, HAS2, HAS3, HAT1, HAUS3, HAUS6, HAVCR2, HDAC5, HDAC7, HDX, HECTD2-AS1, HEG1, HEPH, HEY1, HLA-A, HLA-E, HLTF, HMGA1, HMGA2, HMGB1, HMGCR, HMGN3-AS1, HMGCS1, HOOK3, HMOX1, HNMT, HNRNPR, HNRNPUL1, HP1BP3, HPS1, HRH1, HSD17B12, HSD17B4, HSPA1L, HTATIP2, HTT, IARS, IDH1, IDI1, IFT57, IGDCC4, IGF2BP2, IGF2R, IGFBP3, IL16, IL6ST, INA, INHBA, INPP5K, INSIG1, INTU, IQCE, IQCG, ITGA11, ITGA8, ITGAV, ITGB5, ITGB8, ITIH1, ITM2C, ITPKA, ITSN1, IVD, KANSL3, KAT6B, KCNK2, KCNS1, KCNS2, KDM6A, KDSR, KIAA1033, KIAA1143, KIAA1199, KIAA1456, KIAA1462, KIAA1522, KIAA1524, KIAA1549, KIAA1715, KIAA1755, KIF14, KIF2A, KIF3A, KIT, KLC1, KLC2, KLF17, KLF6, KLHL7, KLRG1, KMT2D, KRT7, KRT18, KRT19, KRT34, KRTAP1-1, KRTAP1-5, KRTAP2-3, L3MBTL2, LAMA2, LAMB1, LAMB2P1, LARP4, LARP7, LATS2, LDLR, LEMD3, LETM2, LGALS8, LGI2, LGR4, LHX9, LIMS1, LINC00341, LINC00472, LINC00570, LINC00578, LINC00607, LINC00657, LINC00678, LINC00702, LINC00886, LINC00961, LINC01011, LINC01118, LINC01204, LMAN2L, LMO7, LMOD1, LOC400927, LONP1, LOX, LRBA, LRCH4, LRIG1, LRP4, LRP8, LRRC32, LRRC39, LRRC42, LRRC8A, LSAMP, LSS, LTBR, LUC7L2, LUM, LYPD1, LYRM1, LZTS2, MADD, MAFB, MAGED4, MAGED4B, MAMDC2, MAN1A2, MAN2A1, MAN2C1, MAP4K4, MAPK13, MASP1, MB, MB21D2, MBD1, MBOAT7, MC4R, MCM10, MDM2, MED1, MED13L, MEDAG, MEF2D, MEGF6, MEIS2, MEMO1, MEPCE, MFGE8, MFN2, MIAT, MICAL2, MINPP1, MIR612, MKL1, MKLN1, MKNK2, MLLT4, MLLT10, MLST8, MMAB, MMP10, MMP24, MMS19, MMS22L, MN1, MOXD1, MPPE1, MPZL1, MRPL3, MRPL45, MRPL55, MRPS28, MRVI1, MSANTD3, MSC, MSH2, MSH4, MSH6, MSL3, MSMO1, MSRB3, MTAP, MTERF3, MTERFD1, MTHFD1L, MTMR9, MTRR, MUM1, MVD, MVK, MXRA5, MYADM, MYCBP2, MYLK, MYO1D, MYO9B, MYOF, NA, NAA35, NAALADL2, NADK, NAE1, NAGS, NASP, NAV1, NAV2, NCOA1, NCOA3, NCOA4, NCSTN, NDNF, NELFA, NEO1, NEURL1B, NF2, NFE2L1, NFX1, NGF, NGFR, NHLH1, NID1, NID2, NIPA1, NKX3-1, NLN, NOL10, NOMO3, NOTCH3, NOTUM, NOVA2, NOX4, NPEPPS, NRD1, NREP, NRG1, NRROS, NSUN4, NT5C2, NT5E, NTNG1, NUDT4, NUP153, NUP35, NUP50, NUPL1, NUSAP1, OCLN, ODF2, OLR1, OS9, OSBPL6, OSBPL10, OSMR, OXCT1, OXCT2, P4HA1, P4HB, PABPC1, PAIP2B, PAK4, PAPD4, PARD3, PARN, PARP1, PARP4, PARVB, PBLD, PCBP2, PCBP4, PCDHGB3, PCGF3, PCM1, PCMTD2, PCNXL2, PCSK9, PDE1C, PDE4A, PDE5A, PDE7A, PDGFD, PDGFRB, PDLIM7, PDS5B, PDXDC1, PEAR1, PEPD, PEX5, PFKP, PHACTR3, PHF19, PHF8, PHRF1, PHTF2, PI4K2A, PIEZO1, PIGN, PIGU, PIK3C2B, PIK3CD, PIK3R1, PIKFYVE, PIM2, PITPNA, PITPNB, PITPNM1, PITPNM3, PLAU, PLEC, PLEK2, PLEKHA1, PLEKHA6, PLEKHB2, PLEKHH2, PLSCR1, PLSCR3, PLXNB2, PLXNC1, PMS1, PNISR, PODN, POLE3, POLN, POLR1A, POLR3D, POMT2, POSTN, POU2F1, PPAPDC1A, PPARA, PPARG, PPHLN1, PPIP5K1, PPIP5K2, PPM1E, PPP1R12A, PPP1R26, PPP3CA, PPP6R1, PPP6R2, PRKACB, PRKCA, PRKDC, PRKG1, PRMT1, PRNP, PRPF31, PRPH2, PRRG4, PRSS23, PRUNE2, PSMA4, PSMC1, PSMD6, PSMD6-AS2, PTGIS, PTK2B, PTPN14, PTX3, PUF60, PUS7, PVR, PXK, PXN, QKI, RAB23, RAB2B, RAB30, RAB34, RAB38, RAB44, RAD1, RAD9B, RAD23B, RAF1, RALB, RAP1A, RAP1GDS1, RAPGEF1, RARG, RARS, RARS2, RASSF8, RBBP8, RBCK1, RBFOX2, RBKS, RBM10, RCC1, RDX, RERE, RFTN1, RFWD2, RFX3-AS1, RGCC, RGS10, RGS3, RIF1, RNF14, RNF19A, RNF38, RNFT1, ROR1, ROR2, RPA1, RPL10, RPS10, RPS6KB2, RPS6KC1, RRBP1, RWDD4, SAMD4A, SAMD9, SAMD9L, SAR1A, SART3, SCAF4, SCAF8, SCARNA9, SCD, SCLT1, SCO1, SDCBP, SEC14L1, SEC22A, SEC24A, SEC24B, SEC61A1, SENP6, SEPT9, SERGEF, SERPINE2, SF1, SGK3, SGOL2, SH3RF1, SH3YL1, SHROOM3, SIGLEC10, SKA2, SKIL, SLC12A2, SLC24A3, SLC25A17, SLC35F3, SLC39A3, SLC39A10, SLC4A4, SLC4A11, SLC41A1, SLC44A2, SLC46A2, SLC6A15, SLC7A6, SLC7A8, SLC7A11, SLC9A3, SLIT3, SMARCA4, SMARCC2, SMC4, SMC6, SMCHD1, SMG1, SMG1P3, SMN2, SMPD4, SMTN, SMYD3, SMYD5, SNAP23, SNED1, SNHG16, SNX7, SNX14, SOCS2, SON, SORBS2, SORCS2, SOS2, SOX7, SPATA18, SPATA20, SPATA5, SPATS2, SPDYA, SPEF2, SPG20, SPIDR, SPRED2, SPRYD7, SQLE, SQRDL, SQSTM1, SRCAP, SREBF1, SREK1, SRGAP1, SRRM1, SRSF3, STAC2, STARD4, STAT1, STAT3, STAT4, STAU1, STC2, STEAP2, STK32B, STRIP1, STRN3, STRN4, STS, STX16, STXBP6, SULF1, SUPT20H, SVEP1, SYNE1, SYNE2, SYNGR2, SYNPO, SYNPO2, SYNPO2L, SYT15, SYTL2, TACC1, TAF2, TAGLN3, TANC2, TANGO6, TARBP1, TARS, TASP1, TBC1D15, TBL2, TCF12, TCF4, TCF7L2, TENC1, TENM2, TEP1, TET3, TEX21P, TFCP2, TGFA, TGFB2, TGFB3, TGFB1, TGFBR1, TGFBRAP1, TGM2, THADA, THAP4, THBS2, THRB, TIAM1, TIMP2, TJP2, TLE3, TLK1, TMC3, TMEM102, TMEM119, TMEM134, TMEM154, TMEM189-UBE2V1, TMEM214, TMEM256-PLSCR3, TMEM47, TMEM50B, TMEM63A, TNC, TNFAIP3, TNFAIP8L3, TNFRSF12A, TNFRSF14, TNIP1, TNKS1BP1, TNPO3, TNRC18P1, TNRC6A, TNS1, TNS3, TNXB, TOE1, TOMM40, TOMM5, TOPORS, TP53AIP1, TP53INP1, TPRG1, TRAF3, TRAK1, TRAPPC12, TRIB1, TRIM2, TRIM23, TRIM26, TRIM28, TRIM65, TRIM66, TRMT1L, TRPC4, TRPS1, TSC2, TSHZ1, TSHZ2, TSPAN11, TSPAN18, TSPAN2, TSPAN7, TSSK3, TTC7A, TTC7B, TUBB2C, TUBB3, TUBE1, TXNIP, TXNL1, TXNRD1, TYW5, U2SURP, UBAP2L, UBE2G2, UBE2V1, UBQLN4, UCHL5, UHMK1, UHRF1BP1L, UNC5B, URGCP, USP19, USP7, USP27X, UVRAG, VANGL1, VARS2, VAV2, VCL, VIM-AS1, VIPAS39, VPS13A, VPS29, VPS41, VPS51, VSTM2L, VWA8, VWF, WDR19, WDR27, WDR37, WDR48, WDR91, WIPF1, WISP1, WNK1, WNT5B, WNT10B, WSB1, WWTR1, XIAP, XRN2, YAP1, YDJC, YES1, YPEL5, YTHDF3, Z24749, ZAK, ZBTB10, ZBTB24, ZBTB26, ZBTB7A, ZC3H12C, ZC3H14, ZC3H18, ZCCHC5, ZCCHC8, ZCCHC11, ZEB1, ZEB2, ZFAND1, ZFAND5, ZFP82, ZHX3, ZMIZ1, ZMIZ1-AS1, ZMYM2, ZNF12, ZNF138, ZNF148, ZNF212, ZNF219, ZNF227, ZNF232, ZNF24, ZNF268, ZNF28, ZNF281, ZNF335, ZNF350, ZNF37A, ZNF37BP, ZNF395, ZNF431, ZNF583, ZNF621, ZNF652, ZNF655, ZNF660, ZNF674, ZNF680, ZNF74, ZNF764, ZNF778, ZNF780A, ZNF79, ZNF827, ZNF837, ZNF839 and ZNF91.

In another specific aspect of the foregoing, the gene is selected from ABCA1, ABCB7, ABCC1, ABHD10, ABL2, ABLIM3, ACACA, ACADVL, ACAT2, ADAM12, ADAM15, ADAM17, ADAM33, AFF2, AGK, AGPAT3, AGPS, AHCYL2, AHDC1, AHRR, AJUBA, AK021888, AK310472, AKAP1, AKAP9, AKNA, ALCAM, ALDH4A1, AMPD2, ANK2, ANKFY1, ANKHD1-EIF4EBP3, ANKRD17, ANKS6, ANP32A, ANXA11, ANXA6, AP2B1, APAF1, APLP2, APP, APPL2, APTX, ARHGAP22, ARID1A, ARID2, ARMCX3, ASAP1, ASL, ASNS, ASPH, ATAD2B, ATF7IP, ATG9A, ATMIN, ATP2C1, ATXN3, AURKA, AXIN1, B4GALT2, BACE1, BAG2, BASP1, BC033281, BCAR3, BEND6, BICD1, BIN1, BNC1, BRD2, BRPF1, BSCL2, BTBD10, BZW1, C11orf30, C11orf73, C17orf76-AS1, C4orf27, C5orf24, C6orf48, C9orf69, CAB39, CALU, CAMKK1, CAPNS1, CASC3, CASP8AP2, CAV1, CCAR1, CCDC77, CCDC88A, CCDC92, CCT6A, CD276, CD46, CDC25B, CDC40, CDC42BPA, CDCA7, CDH11, CDH13, CDK11B, CDK16, CDKAL1, CEP68, CFLAR, CHD8, CIZ1, CLIC1, CLK4, CNOT1, COG1, COL12A1, COL1A1, COL6A1, COPS7B, CPEB2, CREB5, CRLS1, CRTAP, CSDE1, CSNK1A1, CTDSP2, CTNND1, CUL2, CUL4A, CUX1, CYB5B, CYBRD1, CYP51A1, DAB2, DACT1, DARS, DAXX, DCAF10, DCAF11, DCBLD2, DCUN1D4, DDAH1, DDAH2, DDHD2, DDR1, DDX39B, DDX42, DENND1A, DENND1B, DENND5A, DGCR2, DGKA, DHCR24, DHCR7, DHFR, DHX9, DIAPH1, DIAPH3, DIS3L, DKFZp434M1735, DKK3, DLC1, DNM2, DOCK1, DPP8, DSEL, DST, DSTN, EBF1, EEA1, EEF1A1, EFCAB14, EGR1, EHMT2, EIF2B3, EIF4G1, EIF4G2, EIF4G3, ELF2, ENG, ENPP2, ENSA, EPN1, EPT1, ERC1, ERGIC3, ETV5, EXO1, EXTL2, EYA3, FADS1, FADS2, FAF1, FAM111A, FAM198B, FAM219A, FAM219B, FAM3C, FAM65A, FBXO10, FBXO18, FBXO31, FBXO34, FBXO9, FDFT1, FDPS, FER, FEZ1, FGD5-AS1, FGFRL1, FHOD3, FLII, FLNB, FN1, FNBP1, FOCAD, FOS, FOSB, FOSL1, FOXK1, FOXM1, FUS, FYN, GABPB1, GALC, GALNT1, GAS7, GBA2, GCFC2, GGCT, GHDC, GIGYF2, GJC1, GMIP, GNA13, GNAS, GNL3L, GOLGA2, GOLGA4, GOLGB1, GORASP1, GPR1, GPR89A, GPSM2, GREM1, GRK6, GSE1, GTF2H2B, HAS2, HAT1, HAUS3, HAUS6, HDAC7, HEG1, HLA-A, HLA-E, HLTF, HMGA1, HMGB1, HMGCR, HMGCS1, HMOX1, HNRNPR, HNRNPUL1, HP1BP3, HRH1, HSD17B12, HSD17B4, HTT, IARS, IDH1, IDI1, IGF2BP2, IL6ST, INHBA, INSIG1, IQCE, ITGAV, ITGB5, ITM2C, ITSN1, KANSL3, KCNK2, KIAA1033, KIAA1143, KIAA1199, KIAA1522, KIAA1524, KIAA1549, KIAA1715, KIF14, KIF2A, KIF3A, KLC1, KLC2, KLF6, KLHL7, KRT18, KRT19, KRT34, KRTAP2-3, LAMA2, LAMB1, LARP4 LARP7, LATS2, LDLR, LEMD3, LGALS8, LIMS1, LINC00341, LINC00657, LMAN2L, LMO7, LONP1, LOX, LRCH4, LRIG1, LRP8, LRRC8A, LSS, LTBR, LUC7L2, LZTS2, MADD, MAGED4, MAGED4B, MAN1A2, MAP4K4, MBD1, MBOAT7, MDM2, MED1, MEDAG, MEF2D, MEIS2, MEMO1, MEPCE, MFGE8, MICAL2, MINPP1, MKL1, MKLN1, MKNK2, MLLT4, MLST8, MMAB, MMS19, MMS22L, MPPE1, MPZL1, MRPL3, MSANTD3, MSC, MSH2, MSH6, MSL3, MSMO1, MSRB3, MTAP, MTERFD1, MTHFD1L, MTMR9, MTRR, MUM1, MVD, MVK, MYADM, MYLK, MYO1D, MYO9B, MYOF, NAA35, NADK, NASP, NAV1, NAV2, NCOA1, NCOA3, NCOA4, NCSTN, NELFA, NEO1, NEURL1B, NF2, NFE2L1, NFX1, NID1, NID2, NIPA1, NKX3-1, NOL10, NOMO3, NPEPPS, NRD1, NREP, NRG1, NSUN4, NT5C2, NT5E, NTNG1, NUDT4, NUP153, NUP35, NUP50, NUPL1, NUSAP1, ODF2, OS9, OSBPL6, OSMR, P4HA1, P4HB, PABPC1, PAK4, PAPD4, PARD3, PARN, PARP14, PARP4, PARVB, PCBP2, PCBP4, PCDHGB3, PCGF3, PCM1, PCMTD2, PCNXL2, PCSK9, PDE4A, PDE7A, PDLIM7, PDXDC1, PEPD, PEX5, PFKP, PHF19, PHF8, PHRF1, PHTF2, PI4K2A, PIEZO1, PIGU, PIK3C2B, PITPNA, PITPNB, PITPNM1, PLAU, PLEC, PLEKHB2, PLSCR3, PLXNB2, PLXNC1, PMS1, POLE3, POLR3D, POSTN, POU2F1, PPAPDC1A, PPARA, PPHLN1, PPIP5K1, PPPIR12A, PPP6R1, PPP6R2, PRKACB, PRKDC, PRMT1, PRNP, PRSS23, PSMA4, PSMC1, PSMD6, PTK2B, PTPN14, PUF60, PUS7, PVR, PXN, QKI, RAB23, RAB2B, RAB34, RAD1, RAD23B, RALB, RAP1A, RAP1GDS1, RARG, RASSF8, RBCK1, RBFOX2, RBM10, RCC1, RFTN1, RFWD2, RGS10, RGS3, RIF1, RNF14, RNF19A, RNF38, RNFT1, RPL10, RPS6KC1, RRBP1, RWDD4, SAMD9, SAMD9L, SAR1A, SART3, SCAF4, SCAF8, SCD, SCLT1, SCO1, SDCBP, SEC14L1, SEC22A, SEC24B, SEC61A1, SEPT9, SERPINE2, SF1, SGOL2, SH3RF1, SKIL, SLC25A17, SLC39A3, SLC41A1, SLC4A4, SLC7A6, SLC7A8, SMARCA4, SMARCC2, SMC4, SMC6, SMCHD1, SMG1, SMN2, SMPD4, SMYD3, SMYD5, SNAP23, SNHG16, SNX14, SOCS2, SON, SOS2, SPATA20, SPATS2, SPG20, SPRED2, SQLE, SQRDL, SQSTM1, SRCAP, SREBF1, SREK1, SRSF3, STARD4, STAT1, STAT3, STAU1, STC2, STEAP2, STRIP1, STRN3, STX16, SUPT20H, SYNE1, SYNE2, SYT15, SYTL2, TACC1, TAF2, TANC2, TARBP1, TARS, TBC1D15, TBL2, TCF7L2, TENC1, TENM2, TEP1, TET3, TFCP2, TGFB1, TGFBR1, TGFBRAP1, THADA, THAP4, THRB, TIMP2, TJP2, TLE3, TLK1, TMEM154, TMEM47, TMEM63A, TNC, TNFAIP3, TNFRSF12A, TNIP1, TNKS1BP1, TNPO3, TNS1, TNS3, TOE1, TOMM40, TOMM5, TOPORS, TP53INP1, TRAF3, TRAK1, TRAPPC12, TRIB1, TRIM2, TRIM23, TRIM26, TRIM28, TRIM65, TRMT1L, TRPS1, TSC2, TSHZ1, TSPAN2, TTC7A, TUBB2C, TUBB3, TXNL1, TXNRD1, U2SURP, UBAP2L, UBE2G2, UBE2V1, UBQLN4, UCHL5, UHMK1, UHRF1BP1L, UNC5B, USP19, USP7, VANGL1, VARS2, VCL, VIPAS39, VPS13A, VPS29, VPS51, VWA8, WDR19, WDR37, WDR48, WIPF1, WNT5B, WSB1, WWTR1, XIAP, XRN2, YAP1, YES1, YPEL5, YTHDF3, Z24749, ZAK, ZBTB10, ZBTB24, ZBTB7A, ZC3H12C, ZC3H14, ZC3H18, ZCCHC11, ZEB1, ZEB2, ZFAND1, ZFAND5, ZHX3, ZMIZ1, ZMYM2, ZNF12, ZNF148, ZNF219, ZNF227, ZNF24, ZNF268, ZNF28, ZNF281, ZNF335, ZNF37A, ZNF37BP, ZNF395, ZNF583, ZNF621, ZNF652, ZNF655, ZNF674, ZNF74, ZNF764, ZNF778, ZNF780A, ZNF827, ZNF839 and ZNF91.

In another specific aspect of the foregoing, the gene is selected from ABCB8, ANKRD36, APLP2, ARHGAP12, ARMCX6, ASAP1, ATG5, AXIN1, BIRC6, C1orf86, CDC42BPA, CLTA, DYRK1A, ERGIC3, FBXL6, FOXM1, GGCT, KAT6B, KDM6A, KIF3A, KMT2D, LARP7, LYRM1, MADD, MAN2C1, MRPL55, MYCBP2, MYO9B, PNISR, RAP1A, RAPGEF1, SENP6, SH3YL1, SLC25A17, SMN2, SREK1, STRN3, TAF2, TMEM134, VPS29, ZFAND1 and ZNF431.

In another specific aspect of the foregoing, the gene is selected from ABCB8, ANKRD36, ARHGAP12, ARMCX6, ATG5, BIRC6, C1orf86, CLTA, DYRK1A, FBXL6, KAT6B, KDM6A, KMT2D, LYRM1, MAN2C1, MRPL55, MYCBP2, PNISR, RAPGEF1, SENP6, SH3YL1, TMEM134 and ZNF431.

In another specific aspect of the foregoing, the gene is selected from ABCA10, ABCC1, ACTA2, ADAL, ADAM12, ADAMTS1, ADAMTS5, ADD1, ADGRG6, ADH6, ADHFE1, AFF2, AFF3, AGK, AGPS, AKAP3, ANK1, ANK2, ANK3, ANKRD33B, ANXA11, ANXA6, AP4B1-AS1, ARHGEF16, ARID5B, ARL9, ARMCX3, ASAP1, ASIC1, ATP2A3, B3GALT2, B3GNT6, BCL2L15, BCYRN1, BIN3-IT, BIRC3, BTG2, C10orf54, C11orf70, C11orf73, C11orf94, C12orf56, C19orf47, C3, C4orf27, C7orf31, C8orf34, CA13, CA3, CACNA2D2, CACNB1, CADM1, CAND2, CCDC79, CCER2, CCNF, CDCA7, CDKAL1, CELSR1, CEMIP, CEP170, CFH, CIITA, CLDN23, CMAHP, CNGA4, CNTD1, COL11A1, COL12A1, COL14A1, COL15A1, COL5A1, COL5A3, COL6A6, COL8A1, COLEC2, COMP, CPA4, CPQ, CRISPLD2, CRLF1, CRYL1, CUX1, CYB5B, CYB5R2, CYGB, CYP1B1, DCLK1, DCN, DDIT4L, DDX42, DDX50, DEGS1, DENND1A, DENND5A, DEPTOR, DFNB59, DGKA, DHFR, DIAPH3, DIRAS3, DIS3L, DLG5, DNAH8, DNAJC27, DOCK1, DOCK11, DYNC1I1, DZIP1L, EBF1, EFEMP1, EGR3, EIF2B3, ELN, ELP4, EMX2OS, ENPP1, ERCC8, ESM1, EVC2, F2R, FAM160A1, FAM198B, FAM20A, FAM46B, FAM65B, FAP, FARP1, FBLN2, FBN2, FBXO9, FCHO1, FER, FGFR2, FGL2, FLT1, FRAS1, FSCN2, GAL3ST4, GALC, GALNT15, GATA6, GBGT1, GCNT1, GDF6, GNAQ, GOLGB1, GPR183, GPR50, GPRC5A, GPRC5B, GRTP1, GUCA1B, GXYLT1, HAPLN1, HAPLN2, HAS3, HAVCR2, HDAC5, HECTD2-AS1, HEPH, HEY1, HLTF, HMGN3-AS1, HMOX1, HOOK3, HSD17B12, HSPA1L, HTATIP2, HTT, IGDCC4, IGF2R, IGFBP3, IL16, INA, INTU, IQCG, ITGA11, ITGA8, ITGB8, ITIH1, ITPKA, KCNS1, KCNS2, KDM6A, KDSR, KIAA1456, KIAA1462, KIAA1524, KIAA1715, KIAA1755, KIT, KLF17, KLRG1, KRT7, KRTAP1-1, KRTAP1-5, L3MBTL2, LAMB2P1, LGI2, LGR4, LHX9, LINC00472, LINC00570, LINC00578, LINC00607, LINC00678, LINC00702, LINC00886, LINC00961, LINC01011, LINC01118, LINC01204, LMOD1, LRBA, LRP4, LRRC32, LRRC39, LSAMP, LUM, LYPD1, LYRM1, MAFB, MAMDC2, MAN1A2, MAN2A1, MAPK13, MASP1, MB, MC4R, MEDAG, MEGF6, MEMO1, MIAT, MIR612, MLLT10, MMP10, MMP24, MMS19, MN1, MOXD1, MRVI1, MSH4, MTERF3, MXRA5, MYO1D, NA, NAALADL2, NAE1, NAGS, NDNF, NEURL1B, NGFR, NHLH1, NLN, NOTCH3, NOTUM, NOVA2, NOX4, NRROS, NTNG1, OCLN, OLR1, OSBPL10, OXCT2, PAIP2B, PAPD4, PBLD, PCM1, PDE1C, PDE5A, PDGFD, PDGFRB, PDS5B, PDXDC1, PEAR1, PEPD, PHACTR3, PI4K2B, PIK3R1, PIM2, PITPNB, PITPNM3, PLAU, PLEK2, PLEKHA6, PLEKHH2, PLXNC1, PMS1, PODN, POLN, POLR1A, POSTN, PPM1E, PPP3CA, PRKCA, PRKDC, PRKG1, PRPH2, PRRG4, PRUNE2, PSMD6-AS2, PTGIS, PTX3, RAB30, RAB38, RAB44, RAD9B, RARS, RBBP8, RBKS, RCC1, RDX, RFWD2, RFX3-AS1, RGCC, RNFT1, ROR1, ROR2, RWDD4, SCARNA9, SCO1, SEC22A, SHROOM3, SIGLEC10, SLC24A3, SLC35F3, SLC39A10, SLC46A2, SLC4A11, SLC6A15, SLC7A11, SLC9A3, SLIT3, SMG1P3, SMTN, SMYD3, SNED1, SORBS2, SORCS2, SOX7, SPDYA, SPEF2, SQRDL, STAC2, STAT1, STAT4, STEAP2, STK32B, STRN4, STS, STXBP6, SULF1, SVEP1, SYNGR2, SYNPO, SYNPO2, SYNPO2L, TAGLN3, TANGO6, TARBP1, TEX21P, TGFA, TGFB2, TGFB3, TGM2, THADA, THBS2, THRB, TMEM102, TMEM119, TMEM256-PLSCR3, TMEM50B, TNC, TNFAIP8L3, TNFRSF14, TNRC18P1, TNS3, TNXB, TP53AIP1, TPRG1, TRAF3, TRIM66, TRPC4, TSHZ2, TSPAN11, TSPAN18, TSPAN7, TSSK3, TXNIP, UNC5B, USP27X, UVRAG, VIM-AS1, VPS41, VSTM2L, VWA8, VWF, WDR91, WISP1, WNT10B, XRN2, YDJC, ZBTB26, ZCCHC5, ZFP82, ZMIZ1-AS1, ZNF212, ZNF350, ZNF660, ZNF79 and ZNF837.

In another specific aspect of the foregoing, the gene is selected from ABCA10, ACTA2, ADAL, ADAMTS1, ADAMTS5, ADD1, ADGRG6, ADH6, ADHFE1, AFF3, AKAP3, ANK1, ANK3, ANKRD33B, AP4B1-AS1, ARHGEF16, ARID5B, ARL9, ASIC1, ATP2A3, B3GALT2, B3GNT6, BCL2L15, BCYRN1, BIN3-IT1, BIRC3, BTG2, C10orf54, C11orf70, C11orf94, C12orf56, C19orf47, C3, C7orf31, C8orf34, CA13, CA3, CACNA2D2, CACNB1, CADM1, CAND2, CCDC79, CCER2, CCNF, CELSR1, CEMIP, CEP170, CFH, CIITA, CLDN23, CMAHP, CNGA4, CNTD1, COL11A1, COL14A1, COL15A1, COL5A1, COL5A3, COL6A6, COL8A1, COLEC12, COMP, CPA4, CPQ, CRISPLD2, CRLF1, CRYL1, CYB5R2, CYGB, CYP1B1, DCLK1, DCN, DDIT4L, DDX50, DEGS1, DEPTOR, DFNB59, DIRAS3, DLG5, DNAH8, DNAJC27, DOCK11, DYNC1I1, DZIP1L, EFEMP1, EGR3, ELN, ELP4, EMX2OS, ENPP1, ERCC8, ESM1, EVC2, F2R, FAM160A1, FAM20A, FAM46B, FAM65B, FAP, FARP1, FBLN2, FBN2, FBXO9, FCHO1, FGFR2, FGL2, FLT1, FRAS1, FSCN2, GAL3ST4, GALNT15, GATA6, GBGT1, GCNT1, GDF6, GNAQ, GPR183, GPR50, GPRC5A, GPRC5B, GRTP1, GUCA1B, GXYLT1, HAPLN1, HAPLN2, HAS3, HAVCR2, HDAC5, HECTD2-AS1, HEPH, HEY1, HMGN3-AS1, HOOK3, HSPA1L, HTATIP2, IGDCC4, IGF2R, IGFBP3, IL16, INA, INTU, IQCG, ITGA11, ITGA8, ITGB8, ITIH1, ITPKA, KCNS1, KCNS2, KDM6A, KDSR, KIAA1456, KIAA1462, KIAA1755, KIT, KLF17, KLRG1, KRT7, KRTAP1-1, KRTAP1-5, L3MBTL2, LAMB2P1, LGI2, LGR4, LHX9, LINC00472, LINC00570, LINC00578, LINC00607, LINC00678, LINC00702, LINC00886, LINC00961, LINC01011, LINC01118, LINC01204, LMOD1, LRBA, LRP4, LRRC32, LRRC39, LSAMP, LUM, LYPD1, MAFB, MAMDC2, MAN2A1, MAPK13, MASP1, MB, MC4R, MEGF6, MIAT, MIR612, MLLT10, MMP10, MMP24, MN1, MOXD1, MRVI1, MSH4, MTERF3, MXRA5, NA, NAALADL2, NAE1, NAGS, NDNF, NGFR, NHLH1, NLN, NOTCH3, NOTUM, NOVA2, NOX4, NRROS, OCLN, OLR1, OSBPL10, OXCT2, PAIP2B, PBLD, PDE1C, PDE5A, PDGFD, PDGFRB, PDS5B, PEAR1, PHACTR3, PI4K2B, PIK3R1, PIM2, PITPNM3, PLEK2, PLEKHA6, PLEKHH2, PODN, POLN, POLR1A, PPM1E, PPP3CA, PRKCA, PRKG1, PRPH2, PRRG4, PRUNE2, PSMD6-AS2, PTGIS, PTX3, RAB30, RAB38, RAB44, RAD9B, RARS, RBBP8, RBKS, RDX, RFX3-AS1, RGCC, ROR1, ROR2, SCARNA9, SHROOM3, SIGLEC10, SLC24A3, SLC35F3, SLC39A10, SLC46A2, SLC4A11, SLC6A15, SLC7A11, SLC9A3, SLIT3, SMG1P3, SMTN, SNED1, SORBS2, SORCS2, SOX7, SPDYA, SPEF2, STAC2, STAT4, STK32B, STRN4, STS, STXBP6, SULF1, SVEP1, SYNGR2, SYNPO, SYNPO2, SYNPO2L, TAGLN3, TANGO6, TEX21P, TGFA, TGFB2, TGFB3, TGM2, THBS2, TMEM102, TMEM119, TMEM256-PLSCR3, TMEM50B, TNFAIP8L3, TNFRSF14, TNRC18P1, TNXB, TP53AIP1, TPRG1, TRIM66, TRPC4, TSHZ2, TSPAN11, TSPAN18, TSPAN7, TSSK3, TXNIP, USP27X, UVRAG, VIM-AS1, VPS41, VSTM2L, VWF, WDR91, WISP1, WNT10B, YDJC, ZBTB26, ZCCHC5, ZFP82, ZMIZ1-AS1, ZNF212, ZNF350, ZNF660, ZNF79 and ZNF837.

In another specific aspect of the foregoing, the gene is selected from ABCB8, ABCC3, ADAM17, ADCY3, AGPAT4, ANKRA2, ANXA11, APIP, APLP2, ARHGAP1, ARL15, ASAP1, ASPH, ATAD2B, ATXN1, AXIN1, BECN1, BHMT2, BICD1, BTN3A1, C11orf30, C11orf73, C12orf4, C14orf32, C8orf44, C8orf44-SGK3, C8orf88, CASC3, CASP7, CCDC122, CDH13, CECR7, CENPI, CEP112, CEP192, CHEK1, CMAHP, CNRIP1, COPS7B, CPSF4, CRISPLD2, CRYBG3, CSNK1E, CSNK1G1, DAGLB, DCAF17, DCUN1D4, DDX42, DENND1A, DENND5A, DGKA, DHFR, DIAPH3, DLGAP4, DNAJC13, DNMBP, DOCK1, DYRK1A, EIF2B3, ENAH, ENOX1, EP300, ERC1, ERCC1, ERGIC3, ERLIN2, ERRFI1, EVC, FAF1, FAIM, FAM126A, FAM13A, FAM162A, FAM174A, FAM198B, FBN2, FER, FHOD3, FOCAD, GALC, GCFC2, GGACT, GGCT, GLCE, GOLGA4, GOLGB1, GPSM2, GULP1, GXYLT1, HAT1, HDX, HLTF, HMGA2, HNMT, HPS1, HSD17B12, HSD17B4, HTT, IFT57, INPP5K, IVD, KDM6A, KIAA1524, KIAA1715, LETM2, LOC400927, LRRC42, LUC7L3, LYRM1, MADD, MB21D2, MCM10, MED13L, MEDAG, MEMO1, MFN2, MMS19, MRPL45, MRPS28, MTERF3, MYCBP2, MYLK, MYOF, NGF, NREP, NSUN4, NT5C2, OSMR, OXCT1, PAPD4, PCM1, PDE7A, PDS5B, PDXDC1, PIGN, PIK3CD, PIK3R1, PIKFYVE, PITPNB, PLEKHA1, PLSCR1, PMS1, POMT2, PPARG, PPHLN1, PPIP5K2, PPP1R26, PRPF31, PRSS23, PRUNE2, PSMA4, PXK, RAF1, RAP1A, RAPGEF1, RARS2, RBKS, RERE, RFWD2, RNFT1, RPA1, RPS10, RPS6KB2, SAMD4A, SAR1A, SCO1, SEC24A, SENP6, SERGEF, SGK3, SH3YL1, SKA2, SLC12A2, SLC25A17, SLC44A2, SMYD3, SNAP23, SNHG16, SNX7, SOS2, SPATA8, SPATA5, SPIDR, SPRYD7, SRGAP1, SRRM1, STAT1, STRN3, STXBP6, SUPT20H, TAF2, TASP1, TBC1D15, TCF12, TCF4, TIAM1, TJP2, TMC3, TMEM189-UBE2V1, TMEM214, TNRC6A, TNS3, TOE1, TRAF3, TRIM65, TSPAN2, TTC7B, TUBE1, TYW5, UBAP2L, UBE2V1, URGCP, VAV2, VPS29, WDR27, WDR37, WDR91, WNK1, XRN2, ZCCHC8, ZFP82, ZNF138, ZNF232, ZNF37BP and ZNF680.

In another specific aspect of the foregoing, the gene is selected from ABCB8, ABCC3, ADCY3, AGPAT4, ANKRA2, APIP, ARHGAP1, ARL15, ATXN1, BECN1, BHMT2, BTN3A1, C12orf4, C14orf132, C8orf44, C8orf44-SGK3, C8orf88, CASP7, CCDC122, CECR7, CENPI, CEP112, CEP192, CHEK1, CMAHP, CNRIP1, CPSF4, CRISPLD2, CRYBG3, CSNK1E, CSNK1G1, DAGLB, DCAF17, DLGAP4, DNAJC13, DNMBP, DYRK1A, ENAH, EP300, ERCC1, ERLIN2, ERRFI1, EVC, FAIM, FAM126A, FAM13A, FAM162A, FAM174A, FBN2, GGACT, GLCE, GULP1, GXYLT1, HDX, HMGA2, HNMT, HPS1, IFT57, INPP5K, IVD, KDM6A, LETM2, LOC400927, LRRC42, LYRM1, MB21D2, MCM10, MED13L, MFN2, MRPL45, MRPS28, MTERF3, MYCBP2, NGF, OXCT1, PDS5B, PIGN, PIK3CD, PIK3R1, PIKFYVE, PLEKHA1, PLSCR1, POMT2, PPARG, PPIP5K2, PPP1R26, PRPF31, PRUNE2, PXK, RAF1, RAPGEF1, RARS2, RBKS, RERE, RPA1, RPS10, RPS6KB2, SAMD4A, SEC24A, SENP6, SERGEF, SGK3, SH3YL1, SKA2, SLC12A2, SLC44A2, SNX7, SPATA18, SPATA5, SPIDR, SPRYD7, SRGAP1, SRRM1, STXBP6, TASP1, TCF12, TCF4, TIAM1, TMC3, TMEM189-UBE2V1, TMEM214, TNRC6A, TTC7B, TUBE1, TYW5, URGCP, VAV2, WDR27, WDR91, WNK1, ZCCHC8, ZFP82, ZNF138, ZNF232 and ZNF680.

In another specific aspect of the foregoing, the gene is selected from ABHD10 ADAL, ADAM17, ADAM23, ADAMTS19, AGPAT4, AGPS, AKAP8L, AKT1, ANKRD13C, ANXA11, APIP, APPL2, ARHGAP1, ARHGAP5, ARL15, ARL5B, ARSJ, ASAP1, ATF6, BECN1, BHMT2, BIN3, BNC2, BTBD10, C1QTNF9B-AS1, C1orf27, C11orf30, C11orf73, C11orf76, C12orf4, C2orf47, CACNB1, CACNB4, CADM2, CCNL2, CDH18, CENPI, CEP162, CEP170, CEP192, CEP57, CHEK1, CHRM2, CMAHP, CMSS1, CNOT7, CNRIP1, CNTN1, COPS7B, CRISPLD2, CRYBG3, CUX1, DAAM1, DCAF17, DCUN1D4, DDX42, DENND1A, DENND4A, DENND5A, DET1, DGK1, DHFR, DIAPH3, DLG5, DMXL1, DNAJA4, DNMBP, DYRK1A, DZIP1L, ELMO2, ENAH, ENOX1, EP300, ERC1, ERC2, EVC, EXOC3, EXOC6B, FAM162A, FAM174A, FAM195B, FAM208B, FAM49B, FAM69B, FBN2, FBXL16, FBXO9, FGD4, FHOD3, GALC, GBP1, GLCE, GNG12, GOLGB1, GTSF1, GXYLT1, HDAC5, HDX, HMGXB4, HOXB3, HSD17B4, HTT, IFT57, IKBKAP, INO80, IPP4B, INVS, ITCH, IVD, KDM6A, KDSR, KIAA1524, KIAA1715, KIDINS220, KIF21A, L3MBTL2, LGALS3, LINCR-0002, LINGO2, LOC400927, LPHN1, LRRC1, LRRC42, LYRM1, MACROD2, MANEA, MAPK10, MARCH7, MARCH8, MDN1, MEAF6 MEMO1, MFN2, MLLT10, MMS19, MORF4L1, MRPL39, MRPL45, MRPS28, MTMR3, MYB, MYCBP2, MYLK, NEDD4, NFASC, NGF, NIPA1, NLGN1, NLN, NREP, NSUN4, NUPL1, OSBPL3, PAPD4, PBX3, PCDH10, PDE3A, PDE7A, PDXDC1, PDXDC2P, PELI1, PIGN, PITPNB, PMS1, PNISR, POMT2, PPARG, PPFIBP1, PRPF31, PSMA4, PXK, RAB23, RAF1, RAPGEF1, RASIP1, RBBP8, RCOR3, RERE, RGL1, RNF130, RNF144A, RNF213, RPF2, RPS10, SAMD4A, SCO1, SENP6, SF3B3, SGIP1, SGMS1, SGPL1, SH2B3, SKP1, SLC12A2, SLC25A16, SLC25A17, SMOX, SNAP23, SNX24, SNX7, SOCS6, SOGA2, SORCS1, SPIDR, SPRYD7, SREK1, SSBP1, STRAD8, STXBP4, STXBP6, SUPT20H, TAF2, TARBP1, TASP1, TBCA, TBL1XR1, TCF4, TEKT4P2, TET1, TIAM1, TJAP1, TJP2, TMEM214, TMX3, TNRC6A, TRAF3, TRIM65, TSPAN7, TXNL4B, UBE2D3, UBE2L3, UBN2, UNC3B, URGCP-MRPS24, UVRAG, VDAC2, WDR27, WDR90, WHSC2, WNK1, XRN2, ZFP82, ZMIZ2, ZNF138, ZNF208, ZNF212, ZNF280D, ZNF350, ZNF37BP, ZNF426, ZNF618, ZNF680, ZNF730, ZNF777, ZNF7804A, ZNF836 and ZSCAN25.

In another specific aspect of the foregoing, the gene is selected from APOA2, ASAP1, BRCA1, BRCA2, CDKN1C, CRX, CTRC, DENND5A, DIAPH3, DMD, DNAH11, EIF2B3, GALC, HPS1, HTT, IKBKAP, KIAA1524, LMNA, MECP2, PAPD4, PAX6, PCCB, PITPNB, PTCH1, SLC34A3, SMN2, SPINK5, SREK1, TMEM67, VWF, XDH and XRN2.

In another specific aspect of the foregoing, the gene is selected from ABCA1, ABCA10, ABCB7, ABCB8, ABCC1, ABCC3, ABL2, ABLIM3, ACACA, ACADVL, ACAT2, ACTA2, ADAL, ADAM15, ADAM17, ADAM23, ADAM33, ADAMTS1, ADAMTS19, ADCY3, ADD1, ADGRG6, ADH6, ADHFE1, AFF2, AFF3, AGK, AGPAT3, AGPAT4, AGPS, AHCYL2, AHDC1, AHRR, AJUBA, AK021888, AK310472, AKAP1, AKAP3, AKAP8L, AKAP9, AKNA, ALCAM, ALDH4A1, AMPD2, ANK1, ANK2, ANK3, ANKFY1, ANKHD1-EIF4EBP3, ANKRA2, ANKRD13C, ANKRD17, ANKRD33B, ANKRD36, ANKS6, ANP32A, ANXA6, AP2B1, AP4B1-AS1, APAF1, APIP, APOA2, APP, APTX, ARHGAP1, ARHGAP12, ARHGAP22, ARHGAP5, ARHGEF16, ARID1A, ARID2, ARID5B, ARL9, ARL15, ARL5B, ARMCX3, ARSJ, ASAP1, ASIC1, ASL, ASNS, ASPH, ATAD2B, ATF6, ATF7IP, ATG9A, ATMIN, ATP2A3, ATP2C1, ATXN1, ATXN3, AURKA, B3GALT2, B3GNT6, B4GALT2, BACE1, BAG2, BASP1, BC033281, BCAR3, BCL2L15, BCYRN1, BECN1, BEND6, BHMT2, BICD1, BIN1, BIN3, BIN3-IT1, BIRC3, BIRC6, BNC1, BNC2, BRCA1, BRCA2, BRD2, BRPF1, BSCL2, BTBD10, BTG2, BTN3A1, BZW1, C1QTNF9B-AS1, C1orf27, C1orf86, C10orf54, C11orf30, C11orf70, C11orf73, C11orf76, C11orf94, C12orf4, C12orf56, C14orf132, C17orf76-AS1, C19orf47, C2orf47, C3, C4orf27, C5orf24, C6orf48, C7orf31, C8orf34, C8orf44, C8orf44-SGK3, C8orf88, C9orf69, CA13, CA3, CAB39, CACNA2D2, CACNB1, CACNB4, CADM1, CADM2, CALU, CAMKK1, CAND2, CAPNS1, CASC3, CASP7, CASP8AP2, CAV1, CCAR1, CCDC77, CCDC79, CCDC88A, CCDC92, CCDC122, CCER2, CCNF, CCNL2, CCT6A, CD276, CD46, CDC25B, CDC40, CDC42BPA, CDCA7, CDH11, CDH13, CDH18, CDK11B, CDK16, CDKAL1, CDKN1C, CECR7, CELSR1, CEMIP, CENPI, CEP112, CEP162, CEP170, CEP192, CEP68, CFH, CFLAR, CHD8, CHEK1, CHRM2, CIITA, CIZ1, CLDN23, CLIC1, CLK4, CLTA, CMAHP, CNGA4, CNOT1, CNRIP1, CNTD1, CMSS1, CNOT7, CNRIP1, CNTN1, COG1, COL1A1, COL11A1, COL12A1, COL14A1, COL15A1, COL5A1, COL5A3, COL6A1, COL6A6, COL8A1, COLEC12, COMP, COPS7B, CPA4, CPEB2, CPQ, CPSF4, CREB5, CRISPLD2, CRLF1, CRLS1, CRTAP, CRX, CRYBG3, CRYL1, CSDE1, CSNK1A1, CSNK1E, CSNK1G1, CTDSP2, CTNND1, CTRC, CUL2, CUL4A, CUX1, CYB5B, CYB5R2, CYBRD1, CYGB, CYP1B1, CYP51A1, DAAM1, DAB2, DACT1, DAGLB, DARS, DAXX, DCAF10, DCAF11, DCAF17, DCBLD2, DCLK1, DCN, DCUN1D4, DDAH1, DDAH2, DDHD2, DDIT4L, DDR1, DDX39B, DDX42, DDX50, DEGS1, DENND1A, DENND1B, DENND4A, DENND5A, DEPTOR, DET1, DFNB59, DGCR2, DGK1, DGKA, DHCR24, DHCR7, DHFR, DHX9, DIAPH1, DIAPH3, DIRAS3, DIS3L, DKFZp434M1735, DKK3, DLC1, DLG5, DMD, DMXL1, DNAH8, DNAH11, DNAJA4, DNAJC13, DNAJC27, DNM2, DNMBP, DOCK1, DOCK11, DPP8, DSEL, DST, DSTN, DYNC1I1, DYRK1A, DZIP1L, EBF1, EEA1, EEF1A1, EFCAB14, EFEMP1, EGR1, EGR3, EHMT2, EIF2B3, EIF4G1, EIF4G2, EIF4G3, ELF2, ELMO2, ELN, ELP4, EMX2OS, ENAH, ENG, ENOX1, ENPP1, ENPP2, ENSA, EP300, EPT1, ERC1, ERC2, ERCC1, ERCC8, ERLIN2, ERRFI1, ESM1, ETV5, EVC, EVC2, EXO1, EXOC3, EXOC6B, EXTL2, EYA3, F2R, FADS1, FADS2, FAF1, FAIM, FAM111A, FAM126A, FAM13A, FAM160A1, FAM162A, FAM174A, FAM195B, FAM198B, FAM20A, FAM208B, FAM219A, FAM219B, FAM3C, FAM46B, FAM49B, FAM65A, FAM65B, FAM69B, FAP, FARP1, FBLN2, FBN2, FBXL16, FBXL6, FBXO9, FBXO10, FBXO18, FBXO31, FBXO34, FBXO9, FCHO1, FDFT1, FDPS, FER, FEZ1, FGD4, FGD5-AS1, FGFR2, FGFRL1, FGL2, FHOD3, FLII, FLNB, FLT1, FN1, FNBP1, FOCAD, FOS, FOSB, FOSL1, FOXK1, FRAS1, FSCN2, FUS, FYN, GABPB1, GAL3ST4, GALC, GALNT1, GALNT15, GAS7, GATA6, GBA2, GBGT1, GBP1, GCFC2, GLCE, GCNT1, GDF6, GGACT, GHDC, GIGYF2, GJC1, GLCE, GMIP, GNA13, GNAQ, GNAS, GNG12, GNL3L, GOLGA2, GOLGA4, GOLGB1, GORASP1, GPR1, GPR183, GPR50, GPR89A, GPRC5A, GPRC5B, GPSM2, GREM1, GRK6, GRTP1, GSE1, GTF2H2B, GTSF1, GUCA1B, GULP1, GXYLT1, HAPLN1, HAPLN2, HAS2, HAS3, HAT1, HAUS3, HAUS6, HAVCR2, HDAC5, HDAC7, HDX, HECTD2-AS1, HEG1, HEPH, HEY1, HLA-A, HLA-E, HLTF, HMGA1, HMGA2, HMGB1, HMGCR, HMGN3-AS1, HMGCS1, HMGXB4, HOOK3, HOXB3, HMOX1, HNMT, HNRNPR, HNRNPUL1, HP1BP3, HPS1, HRH1, HSD17B12, HSPA1L, HTATIP2, HTT, IARS, IDH1, IDI1, IFT57, IGDCC4, IGF2BP2, IGF2R, IGFBP3, IKBKAP, IL16, IL6ST, INA, INHBA, INO80, IPP4B, INPP5K, INSIG1, INTU, INVS, IQCE, IQCG, ITCH, ITGAI1, ITGA8, ITGAV, ITGB5, ITGB8, ITIH1, ITM2C, ITPKA, ITSN1, IVD, KANSL3, KAT6B, KCNK2, KCNS1, KCNS2, KDM6A, KDSR, KIAA1033, KIAA1143, KIAA1199, KIAA1456, KIAA1462, KIAA1522, KIAA1524, KIAA1549, KIAA1715, KIAA1755, KIDINS220, KIF14, KIF2A, KIF21A, KIF3A, KIT, KLC1, KLC2, KLF17, KLF6, KLHL7, KLRG1, KMT2D, KRT7, KRT18, KRT19, KRT34, KRTAP1-1, KRTAP1-5, KRTAP2-3, L3MBTL2, LAMA2, LAMB1, LAMB2P1, LARP4, LATS2, LDLR, LEMD3, LETM2, LGALS3, LGALS8, LGI2, LGR4, LHX9, LIMS1, LINC00341, LINC00472, LINC00570, LINC00578, LINC00607, LINC00657, LINC00678, LINC00702, LINC00886, LINC00961, LINC01011, LINC01118, LINC01204, LINCR-0002, LINGO2, LMAN2L, LMNA, LMO7, LMOD1, LOC400927, LONP1, LOX, LPHN1, LRBA, LRCH4, LRIG1, LRP4, LRP8, LRRC1, LRRC32, LRRC39, LRRC8A, LSAMP, LSS, LTBR, LUC7L2, LUM, LYPD1, LYRM1, LZTS2, MACROD2, MAFB, MAGED4, MAGED4B, MAMDC2, MAN1A2, MAN2A1, MAN2C1, MANEA, MAP4K4, MAPK10, MAPK13, MARCH7, MARCH8, MASP1, MB, MB21D2, MBD1, MBOAT7, MC4R, MCM10, MDM2, MDN1, MEAF6, MECP2, MED1, MED13L, MEDAG, MEF2D, MEGF6, MEIS2, MEMO1, MEPCE, MFGE8, MFN2, MIAT, MICAL2, MINPP1, MIR612, MKL1, MKLN1, MKNK2, MLLT4, MLLT10, MLST8, MMAB, MMP10, MMP24, MMS19, MMS22L, MN1, MORF4L1, MOXD1, MPPE1, MPZL1, MRPL3, MRPL45, MRPL55, MRPS28, MRVI1, MSANTD3, MSC, MSH2, MSH4, MSH6, MSL3, MSMO1, MSRB3, MTAP, MTERF3, MTERFD1, MTHFD1L, MTMR3, MTMR9, MTRR, MUM1, MVD, MVK, MXRA5, MYADM, MYB, MYCBP2, MYLK, MYO1D, MYO9B, MYOF, NA, NAA35, NAALADL2, NADK, NAE1, NAGS, NASP, NAV1, NAV2, NCOA1, NCOA3, NCOA4, NCSTN, NDNF, NEDD4, NELFA, NEO1, NEURL1B, NF2, NFASC, NFE2L1, NFX1, NGF, NGFR, NHLH1, NID1, NID2, NIPA1, NKX3-1, NLGN1, NLN, NOL10, NOMO3, NOTCH3, NOTUM, NOVA2, NOX4, NPEPPS, NRD1, NREP, NRG1, NRROS, NSUN4, NT5C2, NT5E, NTNG1, NUDT4, NUP153, NUP35, NUP50, NUPL1, NUSAP1, OCLN, ODF2, OLR1, OS9, OSBPL3, OSBPL6, OSBPL10, OSMR, OXCT1, OXCT2, P4HA1, P4HB, PABPC1, PAIP2B, PAK4, PAPD4, PARD3, PARN, PARP14, PARP4, PARVB, PAX6, PBLD, PBX3, PCBP2, PCCB, PCDH10, PCDHGB3, PCGF3, PCM1, PCMTD2, PCNXL2, PCSK9, PDE1C, PDE3A, PDE4A, PDE5A, PDE7A, PDGFD, PDGFRB, PDLIM7, PDS5B, PDXDC1, PDXDC2P, PEAR1, PELI1, PEPD, PEX5, PFKP, PHACTR3, PHF19, PHF8, PHRF1, PHTF2, PI4K2A, PIEZO1, PIGN, PIGU, PIK3C2B, PIK3CD, PIK3R1, PIKFYVE, PIM2, PITPNA, PITPNB, PITPNM1, PITPNM3, PLAU, PLEC, PLEK2, PLEKHA1, PLEKHA6, PLEKHB2, PLEKHH2, PLSCR1, PLSCR3, PLXNB2, PLXNC1, PMS1, PNISR, PODN, POLE3, POLN, POLR1A, POLR3D, POMT2, POSTN, POU2F1, PPAPDC1A, PPARA, PPARG, PPFIBP1, PPIP5K1, PPIP5K2, PPM1E, PPP1R12A, PPP1R26, PPP3CA, PPP6R1, PPP6R2, PRKCA, PRKDC, PRKG1, PRMT1, PRNP, PRPF31, PRPH2, PRRG4, PRSS23, PRUNE2, PSMA4, PSMC1, PSMD6, PSMD6-AS2, PTCH1, PTGIS, PTK2B, PTPN14, PTX3, PUF60, PUS7, PVR, PXK, PXN, QKI, RAB2B, RAB30, RAB34, RAB38, RAB44, RAD1, RAD9B, RAD23B, RAF1, RALB, RAP1GDS1, RAPGEF1, RARG, RARS, RARS2, RASIP1, RASSF8, RBBP8, RBCK1, RCOR3, RBFOX2, RBKS, RBM10, RDX, RERE, RFTN1, RFWD2, RFX3-AS1, RGCC, RGL1, RGS10, RGS3, RIF1, RNF14, RNF19A, RNF130, RNF144A, RNF213, RNF38, RNFT1, ROR1, ROR2, RPA1, RPF2, RPL10, RPS10, RPS6KB2, RPS6KC1, RRBP1, RWDD4, SAMD4A, SAMD9, SAMD9L, SAR1A, SART3, SCAF4, SCAF8, SCARNA9, SCD, SCLT1, SCO1, SDCBP, SEC14L1, SEC22A, SEC24A, SEC24B, SEC61A1, SENP6, SEPT9, SERGEF, SERPINE2, SF1, SF3B3, SGIP1, SGK3, SGMS1, SGOL2, SGPL1, SH2B3, SH3RF1, SH3YL1, SHROOM3, SIGLEC10, SKA2, SKIL, SKP1, SLC12A2, SLC24A3, SLC25A16, SLC25A17, SLC34A3, SLC35F3, SLC39A3, SLC39A10, SLC4A4, SLC4A11, SLC41A1, SLC44A2, SLC46A2, SLC6A15, SLC7A6, SLC7A8, SLC7A11, SLC9A3, SLIT3, SMARCA4, SMARCC2, SMC4, SMC6, SMCHD1, SMG1, SMG1P3, SMOX, SMPD4, SMTN, SMYD3, SMYD5, SNAP23, SNED1, SNHG16, SNX7, SNX14, SNX24, SNX7, SOCS2, SOCS6, SOGA2, SON, SORBS2, SORCS1, SORCS2, SOS2, SOX7, SPATA18, SPATA20, SPATA5, SPATS2, SPDYA, SPEF2, SPG20, SPIDR, SPINK5, SPRED2, SPRYD7, SQLE, SQRDL, SQSTM1, SRCAP, SREBF1, SRGAP1, SRRM1, SRSF3, SSBP1, STAC2, STARD4, STAT1, STAT3, STAT4, STAU1, STC2, STEAP2, STK32B, STRAD8, STRIP1, STRN4, STS, STX16, STXBP4, STXBP6, SULF1, SUPT20H, SVEP1, SYNE1, SYNE2, SYNGR2, SYNPO, SYNPO2, SYNPO2L, SYT15, SYTL2, TACC1, TAF2, TAGLN3, TANC2, TANGO6, TARBP1, TARS, TASP1, TBC1D15, TBCA, TBL1XR1, TBL2, TCF12, TCF4, TCF7L2, TEKT4P2, TENC1, TENM2, TEP1, TET1, TET3, TEX21P, TFCP2, TGFA, TGFB2, TGFB3, TGFB1, TGFBR1, TGFBRAP1, TGM2, THADA, THAP4, THBS2, THRB, TIAM1, TIMP2, TJAP1, TJP2, TLE3, TLK1, TMC3, TMEM67, TMEM102, TMEM119, TMEM134, TMEM154, TMEM189-UBE2V1, TMEM214, TMEM256-PLSCR3, TMEM47, TMEM50B, TMEM63A, TMX3, TNC, TNFAIP3, TNFAIP8L3, TNFRSF12A, TNFRSF14, TNIP1, TNKS1BP1, TNPO3, TNRC18P1, TNS1, TNS3, TNXB, TOE1, TOMM40, TOMM5, TOPORS, TP53AIP1, TP53INP1, TPRG1, TRAF3, TRAK1, TRAPPC12, TRIB1, TRIM2, TRIM23, TRIM26, TRIM28, TRIM65, TRIM66, TRMT1L, TRPC4, TRPS1, TSC2, TSHZ1, TSHZ2, TSPAN11, TSPAN18, TSPAN2, TSPAN7, TSSK3, TTC7A, TTC7B, TUBB2C, TUBB3, TUBE1, TXNIP, TXNL1, TXNL4B, TXNRD1, TYW5, U2SURP, UBAP2L, UBE2D3, UBE2G2, UBE2L3, UBE2V1, UBN2, UBQLN4, UCHL5, UHMK1, UHRF1BP1L, UNC13B, UNC5B, URGCP, URGCP-MRPS24, USP19, USP7, USP27X, UVRAG, VANGL1, VARS2, VAV2, VCL, VDAC2, VIM-AS1, VIPAS39, VPS13A, VPS29, VPS41, VPS51, VSTM2L, VWA8, VWF, WDR19, WDR27, WDR37, WDR48, WDR90, WDR91, WHSC2, WIPF1, WISP1, WNK1, WNT5B, WNT10B, WSB1, WWTR1, XDH, XIAP, XRN2, YAP1, YDJC, YES1, YPEL5, YTHDF3, Z24749, ZAK, ZBTB10, ZBTB24, ZBTB26, ZBTB7A, ZC3H12C, ZC3H14, ZC3H18, ZCCHC5, ZCCHC8, ZCCHC11, ZEB1, ZEB2, ZFAND1, ZFAND5, ZFP82, ZHX3, ZMIZ1, ZMIZ1-AS1, ZMIZ2, ZMYM2, ZNF12, ZNF138, ZNF148, ZNF208, ZNF212, ZNF219, ZNF227, ZNF232, ZNF24, ZNF268, ZNF28, ZNF280D, ZNF281, ZNF335, ZNF350, ZNF37A, ZNF37BP, ZNF395, ZNF426, ZNF431, ZNF583, ZNF618, ZNF621, ZNF652, ZNF655, ZNF660, ZNF674, ZNF680, ZNF730, ZNF74, ZNF764, ZNF777, ZNF778, ZNF780A, ZNF7804A, ZNF79, ZNF827, ZNF836, ZNF837, ZNF839, ZNF91 and ZSCAN25.

In another aspect, the gene is not SMN2.

In another aspect, the gene is not selected from ABHD10, ADAM12, AKT1, ANXA11, APLP2, APPL2, ARMCX6, ATG5, AXIN1, BAIAP2, CCNB1IP1, CCT7, CEP57, CSF1, DLGAP4, EPN1, ERGIC3, FOXM1, GGCT, GRAMD3, HSD17B4, LARP7, LRRC42, MADD, MAN1B1, MRPL39, PCBP4, PPHLN1, PRKACB, RAB23, RAP1A, RCC1, SREK1, STRN3 and TNRC6A.

In another aspect, the gene is not selected from ABHD10, ADAM12, AKT1, ANXA11, APLP2, APPL2, ARMCX6, ATG5, AXIN1, BAIAP2, CCNB1IP1, CCT7, CEP57, CSF1, DLGAP4, EPN1, ERGIC3, FOXM1, GGCT, GRAMD3, HSD17B4, LARP7, LRRC42, MADD, MAN1B1, MRPL39, PCBP4, PPHLN1, PRKACB, RAB23, RAP1A, RCC1, SMN2, SREK1, STRN3 and TNRC6A.

In another particular aspect, provided herein are methods for modifying RNA splicing in order to modulate the amount of one, two, three or more RNA transcripts of a gene in a subject, wherein the precursor RNA transcript transcribed from the gene comprises an intronic REMS (for example, an endogenous intronic REMS or a non-endogenous intronic REMS), the methods comprising administering to the subject a compound of Formula (I) or a form thereof, or a pharmaceutical composition comprising a compound of Formula (I) or a form thereof and a pharmaceutically acceptable carrier, excipient or diluent. In a specific aspect, the precursor RNA transcript contains in 5' to 3' order: a branch point, a 3' splice site and an intronic REMS. In another specific aspect, the precursor RNA transcript contains in 5' to 3' order: a first 5' splice site, a first branch point, a first 3' splice site, an intronic REMS, a second branch point, and a second 3' splice site. In another specific aspect the precursor RNA transcript contains in 5' to 3' order: an intronic REMS, a branch point, and a 3' splice site.

In another particular aspect, provided herein are methods for modifying RNA splicing in order to modulate the amount of one, two, three or more RNA transcripts of a gene in a subject, wherein the precursor RNA transcript transcribed from the gene comprises a non-endogenous intronic REMS, the methods comprising administering to the subject a compound of Formula (I) or a form thereof, or a pharmaceutical composition comprising a compound of Formula (I) or a form thereof and a pharmaceutically acceptable carrier, excipient or diluent. In a specific aspect, the precursor RNA transcript contains in 5' to 3' order: a branch point, a 3' splice site and an intronic REMS. In another specific aspect, the precursor RNA transcript contains in 5' to 3' order: a first 5' splice site, a first branch point, a first 3' splice site, an intronic REMS, a second branch point, and a second 3' splice site. In another specific aspect the precursor RNA transcript contains in 5' to 3' order: an intronic REMS, a branch point, and a 3' splice site.

In another aspect, provided herein are methods for modifying RNA splicing in order to modulate the amount of one, two, three or more RNA transcripts of a gene, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In a specific aspect, the precursor RNA transcript contains in 5' to 3' order: a branch point, a 3' splice site and an intronic REMS. In another specific aspect, the precursor RNA transcript contains in 5' to 3' order: a first 5' splice site, a first branch point, a first 3' splice site, an intronic REMS, a second branch point, and a second 3' splice site. In another specific aspect the precursor RNA transcript contains in 5' to 3' order: an intronic REMS, a branch point, and a 3' splice site.

In another aspect, provided herein are methods for modifying RNA splicing in order to modulate the amount of one, two, three or more RNA transcripts of a gene described herein, comprising administering to a human or non-human subject a compound of Formula (I) or a form thereof, or a pharmaceutical composition comprising a compound of Formula (I) or a form thereof and a pharmaceutically acceptable carrier, excipient or diluent. See the example section for additional information regarding the genes described herein.

In another aspect, provided herein is a method for modifying RNA splicing in order to modulate the amount of a product of a gene (such as an RNA transcript or a protein) in a subject, wherein the gene comprises a DNA nucleotide sequence encoding two exons and an intron, wherein the nucleotide sequence encoding a first exon is upstream of the nucleotide sequence encoding the intron and the nucleotide sequence encoding a second exon is downstream of the nucleotide sequence encoding the intron, wherein the DNA nucleotide sequence encoding the intron comprises in 5' to 3' order: a nucleotide sequence encoding a first 5' splice site, a nucleotide sequence encoding a first branch point, a nucleotide sequence encoding a first 3' splice site, a nucleotide sequence encoding an iREMS, a nucleotide sequence encoding a second branch point and a nucleotide sequence encoding a second 3' splice site, wherein the nucleotide sequence encoding the iREMS comprises a DNA sequence GAgtrngn, and wherein r is adenine or guanine and n is any nucleotide, the method comprising administering a compound described herein (for example, a compound of Formula (I) or a form thereof) to the subject.

In another aspect, provided herein is a method for modifying RNA splicing in order to modulate the amount of a product of a gene (such as an RNA transcript or protein) in a subject, wherein the gene comprises a DNA nucleotide sequence encoding two exons and an intron, wherein the nucleotide sequence encoding a first exon is upstream of the nucleotide sequence encoding the intron and the nucleotide sequence encoding a second exon is downstream of the nucleotide sequence encoding the intron, wherein the DNA nucleotide sequence of the intron comprises in 5' to 3' order: a nucleotide sequence encoding an iREMS, a nucleotide sequence encoding a branch point and a nucleotide sequence encoding a 3' splice site, wherein the nucleotide sequence encoding the iREMS comprises a DNA sequence GAgtrngn, and wherein r is adenine or guanine and n is any nucleotide, the method comprising administering a compound described herein (for example, a compound of Formula (I) or a form thereof) to the subject.

In another aspect, provided herein is a method for modifying RNA splicing in order to modulate the amount of a product of a gene (such as an RNA transcript or protein) in a subject, wherein the gene comprises a DNA nucleotide sequence encoding two exons and an intron, and wherein the DNA nucleotide sequence encodes exonic and intronic elements illustrated in FIG. 1A, the method comprising administering a compound described herein (for example, a compound of Formula (I) or a form thereof) to the subject.

In another aspect, provided herein is a method for modifying RNA splicing in order to modulate the amount of a product of a gene (such as an RNA transcript or protein) in a subject, wherein the gene comprises a DNA nucleotide sequence encoding two exons and an intron, and wherein the DNA nucleotide sequence encodes exonic and intronic elements illustrated in FIG. 1B, the method comprising administering a compound described herein (for example, a compound of Formula (I) or a form thereof) to the subject.

In another aspect, provided herein is a method for modifying RNA splicing in order to modulate the amount of a product of a gene (such as an RNA transcript or protein) in a subject, wherein the gene comprises a DNA nucleotide sequence encoding two exons and an intron, and wherein the DNA nucleotide sequence encodes exonic and intronic elements illustrated in FIG. 1C, the method comprising administering a compound described herein (for example, a compound of Formula (I) or a form thereof) to the subject.

In a specific aspect, the gene is a gene described in a table in this disclosure.

In certain aspects, a compound of Formula (I) or a form thereof contacted or cultured with a cell(s), or administered to a subject is a compound described herein.

Table 3 shows certain genes that are expected to demonstrate an effect on inclusion of an iExon or formation of an eExon with a corresponding change in isoform abundance as a result of iExon or eExon generation in RNA having intronic REMS elements in the presence of a compound as described herein. The change in abundance is expected to have a statistically significant p value.

TABLE 3

Table 3

ABCA1, ABCA10, ABCB7, ABCB8, ABCC1, ABCC3, ABHD10, ABL2, ABLIM3,
ACACA, ACADVL, ACAT2, ACTA2, ADAL, ADAM12, ADAM15, ADAM17, ADAM23,
ADAM33, ADAMTS1, ADAMTS19, ADCY3, ADD1, ADGRG6, ADH6, ADHFE1, AFF2,
AFF3, AGK, AGPAT3, AGPAT4, AGPS, AHCYL2, AHDC1, AHRR, AJUBA, AK021888,
AK310472, AKAP1, AKAP3, AKAP8L, AKAP9, AKNA, AKT1, ALCAM, ALDH4A1,
AMPD2, ANK1, ANK2, ANK3, ANKFY1, ANKHD1-EIF4EBP3, ANKRA2, ANKRD13C,
ANKRD17, ANKRD33B, ANKRD36, ANKS6, ANP32A, ANXA11, ANXA6, AP2B1,
AP4B1-AS1, APAF1, APIP, APLP2, APOA2, APP, APPL2, APTX, ARHGAP1,
ARHGAP12, ARHGAP22, ARHGAP5, ARHGEF16, ARID1A, ARID2, ARID5B, ARL9,
ARL15, ARL5B, ARMCX3, ARMCX6, ARSJ, ASAP1, ASIC1, ASL, ASNS, ASPH,
ATAD2B, ATF6, ATF7IP, ATG5, ATG9A, ATMIN, ATP2A3, ATP2C1, ATXN1, ATXN3,
AURKA, AXIN1, B3GALT2, B3GNT6, B4GALT2, BACE1, BAG2, BASP1, BC033281,
BCAR3, BCL2L15, BCYRN1, BECN1, BEND6, BHMT2, BICD1, BIN1, BIN3, BIN3-IT1,
BIRC3, BIRC6, BNC1, BNC2, BRCA1, BRCA2, BRD2, BRPF1, BSCL2, BTBD10, BTG2,
BTN3A1, BZW1, C1QTNF9B-AS1, C1orf27, C1orf86, C10orf54, C11orf30, C11orf70,
C11orf73, C11orf76, C11orf94, C12orf4, C12orf56, C14orf132, C17orf76-AS1, C19orf47,
C2orf47, C3, C4orf27, C5orf24, C6orf48, C7orf31, C8orf34, C8orf44, C8orf44-SGK3,
C8orf88, C9orf69, CA13, CA3, CAB39, CACNA2D2, CACNB1, CACNB4, CADM1,
CADM2, CALU, CAMKK1, CAND2, CAPNS1, CASC3, CASP7, CASP8AP2, CAV1,
CCAR1, CCDC77, CCDC79, CCDC88A, CCDC92, CCDC122, CCER2, CCNF, CCNL2,
CCT6A, CD276, CD46, CDC25B, CDC40, CDC42BPA, CDCA7, CDH11, CDH13, CDH18,
CDK11B, CDK16, CDKAL1, CDKN1C, CECR7, CELSR1, CEMIP, CENPI, CEP112,
CEP162, CEP170, CEP192, CEP57, CEP68, CFH, CFLAR, CHD8, CHEK1, CHRM2, CIITA,
CIZ1, CLDN23, CLIC1, CLK4, CLTA, CMAHP, CNGA4, CNOT1, CNRIP1, CNTD1,
CMSS1, CNOT7, CNRIP1, CNTN1, COG1, COL1A1, COL11A1, COL12A1, COL14A1,
COL15A1, COL5A1, COL5A3, COL6A1, COL6A6, COL8A1, COLEC12, COMP, COPS7B,
CPA4, CPEB2, CPQ, CPSF4, CREB5, CRISPLD2, CRLF1, CRLS1, CRTAP, CRX,
CRYBG3, CRYL1, CSDE1, CSNK1A1, CSNK1E, CSNK1G1, CTDSP2, CTNND1, CTRC,
CUL2, CUL4A, CUX1, CYB5B, CYB5R2, CYBRD1, CYGB, CYP1B1, CYP51A1,
DAAM1, DAB2, DACT1, DAGLB, DARS, DAXX, DCAF10, DCAF11, DCAF17, DCBLD2,
DCLK1, DCN, DCUN1D4, DDAH1, DDAH2, DDHD2, DDIT4L, DDR1, DDX39B, DDX42,
DDX50, DEGS1, DENND1A, DENND1B, DENND4A, DENND5A, DEPTOR, DET1,
DFNB59, DGCR2, DGK1, DGKA, DHCR24, DHCR7, DHFR, DHX9, DIAPH1, DIAPH3,
DIRAS3, DIS3L, DKFZp434M1735, DKK3, DLC1, DLG5, DLGAP4, DMD, DMXL1,
DNAH8, DNAH11, DNAJA4, DNAJC13, DNAJC27, DNM2, DNMBP, DOCK1, DOCK11,
DPP8, DSEL, DST, DSTN, DYNC1I1, DYRK1A, DZIP1L, EBF1, EEA1, EEF1A1,
EFCAB14, EFEMP1, EGR1, EGR3, EHMT2, EIF2B3, EIF4G1, EIF4G2, EIF4G3, ELF2,
ELMO2, ELN, ELP4, EMX2OS, ENAH, ENG, ENOX1, ENPP1, ENPP2, ENSA, EP300,
EPN1, EPT1, ERC1, ERC2, ERCC1, ERCC8, ERGIC3, ERLIN2, ERRFI1, ESM1, ETV5,
EVC, EVC2, EXO1, EXOC3, EXOC6B, EXTL2, EYA3, F2R, FADS1, FADS2, FAF1,
FAIM, FAM111A, FAM126A, FAM13A, FAM160A1, FAM162A, FAM174A, FAM195B,
FAM198B, FAM20A, FAM208B, FAM219A, FAM219B, FAM3C, FAM46B, FAM49B,
FAM65A, FAM65B, FAM69B, FAP, FARP1, FBLN2, FBN2, FBXL16, FBXL6, FBXO9,
FBXO10, FBXO18, FBXO31, FBXO34, FBXO9, FCHO1, FDFT1, FDPS, FER, FEZ1,
FGD4, FGD5-AS1, FGFR2, FGFRL1, FGL2, FHOD3, FLII, FLNB, FLT1, FN1, FNBP1,
FOCAD, FOS, FOSB, FOSL1, FOXK1, FOXM1, FRAS1, FSCN2, FUS, FYN, GABPB1,
GAL3ST4, GALC, GALNT1, GALNT15, GAS7, GATA6, GBA2, GBGT1, GBP1, GCFC2,
GLCE, GCNT1, GDF6, GGACT, GGCT, GHDC, GIGYF2, GJC1, GLCE, GMIP, GNA13,
GNAQ, GNAS, GNG12, GNL3L, GOLGA2, GOLGA4, GOLGB1, GORASP1, GPR1,
GPR183, GPR50, GPR89A, GPRC5A, GPRC5B, GPSM2, GREM1, GRK6, GRTP1, GSE1,
GTF2H2B, GTSF1, GUCA1B, GULP1, GXYLT1, HAPLN1, HAPLN2, HAS2, HAS3,
HAT1, HAUS3, HAUS6, HAVCR2, HDAC5, HDAC7, HDX, HECTD2-AS1, HEG1, HEPH,
HEY1, HLA-A, HLA-E, HLTF, HMGA1, HMGA2, HMGB1, HMGCR, HMGN3-AS1,
HMGCS1, HMGXB4, HOOK3, HOXB3, HMOX1, HNMT, HNRNPR, HNRNPUL1,
HP1BP3, HPS1, HRH1, HSD17B12, HSD17B4, HSPA1L, HTATIP2, HTT, IARS, IDH1,
IDI1, IFT57, IGDCC4, IGF2BP2, IGF2R, IGFBP3, IKBKAP, IL16, IL6ST, INA, INHBA,
INO80, IPP4B, INPP5K, INSIG1, INTU, INVS, IQCE, IQCG, ITCH, ITGA11, ITGA8,
ITGAV, ITGB5, ITGB8, ITIH1, ITM2C, ITPKA, ITSN1, IVD, KANSL3, KAT6B, KCNK2,
KCNS1, KCNS2, KDM6A, KDSR, KIAA1033, KIAA1143, KIAA1199, KIAA1456,
KIAA1462, KIAA1522, KIAA1524, KIAA1549, KIAA1715, KIAA1755, KIDINS220,
KIF14, KIF2A, KIF21A, KIF3A, KIT, KLC1, KLC2, KLF17, KLF6, KLHL7, KLRG1,
KMT2D, KRT7, KRT18, KRT19, KRT34, KRTAP1-1, KRTAP1-5, KRTAP2-3, L3MBTL2,
LAMA2, LAMB1, LAMB2P1, LARP4, LARP7, LATS2, LDLR, LEMD3, LETM2, LGALS3,
LGALS8, LGI2, LGR4, LHX9, LIMS1, LINC00341, LINC00472, LINC00570, LINC00578,
LINC00607, LINC00657, LINC00678, LINC00702, L1NC00886, LINC00961, LINC01011,
LINC01118, LINC01204, LINCR-0002, LINGO2, LMAN2L, LMNA, LMO7, LMOD1,
LOC400927, LONP1, LOX, LPHN1, LRBA, LRCH4, LRIG1, LRP4, LRP8, LRRC1,
LRRC32, LRRC39, LRRC42, LRRC8A, LSAMP, LSS, LTBR, LUC7L2, LUM, LYPD1,
LYRM1, LZTS2, MACROD2, MADD, MAFB, MAGED4, MAGED4B, MAMDC2,
MAN1A2, MAN2A1, MAN2C1, MANEA, MAP4K4, MAPK10, MAPK13, MARCH7,
MARCH8, MASP1, MB, MB21D2, MBD1, MBOAT7, MC4R, MCM10, MDM2, MDN1, TABLE 3-continued Table 3

MEAF6, MECP2, MED1, MED13L, MEDAG, MEF2D, MEGF6, MEIS2, MEMO1, MEPCE,
MFGE8, MFN2, MIAT, MICAL2, MINPP1, MIR612, MKL1, MKLN1, MKNK2, MLLT4,
MLLT10, MLST8, MMAB, MMP10, MMP24, MMS19, MMS22L, MN1, MORF4L1,
MOXD1, MPPE1, MPZL1, MRPL3, MRPL39, MRPL45, MRPL55, MRPS28, MRVI1,
MSANTD3, MSC, MSH2, MSH4, MSH6, MSL3, MSMO1, MSRB3, MTAP, MTERF3,
MTERFD1, MTHFD1L, MTMR3, MTMR9, MTRR, MUM1, MVD, MVK, MXRA5,
MYADM, MYB MYCBP2, MYLK, MYO1D MYO9B, MYOF, NA, NAA35, NAALADL2,
NADK, NAE1, NAGS, NASP, NAV1, NAV2, NCOA1, NCOA3, NCOA4, NCSTN, NDNF,
NEDD4, NELFA, NEO1, NEURL1B, NF2, NFASC, NFE2L1, NFX1, NGF, NGFR, NHLH1,
NID1, NID2, NIPA1, NKX3-1, NLGN1, NLN, NOL10, NOMO3, NOTCH3, NOTUM,
NOVA2, NOX4, NPEPPS, NRD1, NREP, NRG1, NRROS, NSUN4, NT5C2, NT5E, NTNG1,
NUDT4, NUP153, NUP35, NUP50, NUPL1, NUSAP1, OCLN, ODF2, OLR1, OS9, OSBPL3,
OSBPL6, OSBPL10, OSMR, OXCT1, OXCT2, P4HA1, P4HB, PABPC1, PAIP2B, PAK4,
PAPD4, PARD3, PARN, PARP14, PARP4, PARVB, PAX6, PBLD, PBX3, PCBP2, PCBP4,
PCCB, PCDH10, PCDHGB3, PCGF3, PCM1, PCMTD2, PCNXL2, PCSK9, PDE1C, PDE3A,
PDE4A, PDE5A, PDE7A, PDGFD, PDGFRB, PDLIM7, PDS5B, PDXDC1, PDXDC2P,
PEAR1, PELI1, PEPD, PEX5, PFKP, PHACTR3, PHF19, PHF8, PHRF1, PHTF2, PI4K2A,
PIEZO1, PIGN, PIGU, PIK3C2B, PIK3CD, PIK3R1, PIKFYVE, PIM2, PITPNA, PITPNB,
PITPNM1, PITPNM3, PLAU, PLEC, PLEK2, PLEKHA1, PLEKHA6, PLEKHB2,
PLEKHH2, PLSCR1, PLSCR3, PLXNB2, PLXNC1, PMS1, PNISR, PODN, POLE3, POLN,
POLR1A, POLR3D, POMT2, POSTN, POU2F1, PPAPDC1A, PPARA, PPARG, PPFIBP1,
PPHLN1, PPIP5K1, PPIP5K2, PPM1E, PPP1R12A, PPP1R26, PPP3CA, PPP6R1, PPP6R2,
PRKACB, PRKCA, PRKDC, PRKG1, PRMT1, PRNP, PRPF31, PRPH2, PRRG4, PRSS23,
PRUNE2, PSMA4, PSMC1, PSMD6, PSMD6-AS2, PTCH1, PTGIS, PTK2B, PTPN14,
PTX3, PUF60, PUS7, PVR, PXK, PXN, QKI, RAB23, RAB2B, RAB30, RAB34, RAB38,
RAB44, RAD1, RAD9B, RAD23B, RAF1, RALB, RAP1A, RAP1GDS1, RAPGEF1, RARG,
RARS, RARS2, RASIP1, RASSF8, RBBP8, RBCK1, RCOR3, RBFOX2, RBKS, RBM10,
RCC1, RDX, RERE, RFTN1, RFWD2, RFX3-AS1, RGCC, RGL1, RGS10, RGS3, RIF1,
RNF14, RNF19A, RNF130, RNF144A, RNF213, RNF38, RNFT1, ROR1, ROR2, RPA1,
RPF2, RPL10, RPS10, RPS6KB2, RPS6KC1, RRBP1, RWDD4, SAMD4A, SAMD9,
SAMD9L, SAR1A, SART3, SCAF4, SCAF8, SCARNA9, SCD, SCLT1, SCO1, SDCBP,
SEC14L1, SEC22A, SEC24A, SEC24B, SEC61A1, SENP6, SEPT9, SERGEF, SERPINE2,
SF1, SF3B3, SGIP1, SGK3, SGMS1, SGOL2, SGPL1, SH2B3, SH3RF1, SH3YL1,
SHROOM3, SIGLEC10, SKA2, SKIL, SKP1, SLC12A2, SLC24A3, SLC25A16, SLC25A17,
PTCH1, SLC35F3, SLC39A3, SLC39A10, SLC4A4, SLC4A11, SLC41A1, SLC44A2,
SLC46A2, SLC6A15, SLC7A6, SLC7A8, SLC7A11, SLC9A3, SLIT3, SMARCA4,
SMARCC2, SMC4, SMC6, SMCHD1, SMG1, SMG1P3, SMN2, SMOX, SMPD4, SMTN,
SMYD3, SMYD5, SNAP23, SNED1, SNHG16, SNX7, SNX14, SNX24, SNX7, SOCS2,
SOCS6, SOGA2, SON, SORBS2, SORCS1, SORCS2, SOS2, SOX7, SPATA18, SPATA20,
SPATA5, SPATS2, SPDYA, SPEF2, SPG20, SPIDR, SPINK5, SPRED2, SPRYD7, SQLE,
SQRDL, SQSTM1, SRCAP, SREBF1, SREK1, SRGAP1, SRRM1, SRSF3, SSBP1, STAC2,
STARD4, STAT1, STAT3, STAT4, STAU1, STC2, STEAP2, STK32B, STRADB, STRIP1,
STRN3, STRN4, STS, STX16, STXBP4, STXBP6, SULF1, SUPT20H, SVEP1, SYNE1,
SYNE2, SYNGR2, SYNPO, SYNPO2, SYNPO2L, SYT15, SYTL2, TACC1, TAF2,
TAGLN3, TANC2, TANGO6, TARBP1, TARS, TASP1, TBC1D15, TBCA, TBL1XR1,
TBL2, TCF12, TCF4, TCF7L2, TEKT4P2, TENC1, TENM2, TEP1, TET1, TET3, TEX21P,
TFCP2, TGFA, TGFB2, TGFB3, TGFBI, TGFBR1, TGFBRAP1, TGM2, THADA, THAP4,
THBS2, THRB, TIAM1, TIMP2, TJAP1, TJP2, TLE3, TLK1, TMC3, TMEM67, TMEM102,
TMEM119, TMEM134, TMEM154, TMEM189-UBE2V1, TMEM214, TMEM256-PLSCR3,
TMEM47, TMEM50B, TMEM63A, TMX3, TNC, TNFAIP3, TNFAIP8L3, TNFRSF12A,
TNFRSF14, TNIP1, TNKS1BP1, TNPO3, TNRC18P1, TNRC6A, TNS1, TNS3, TNXB,
TOE1, TOMM40, TOMM5, TOPORS, TP53AIP1, TP53INP1, TPRG1, TRAF3, TRAK1,
TRAPPC12, TRIB1, TRIM2, TRIM23, TRIM26, TRIM28, TRIM65, TRIM66, TRMT1L,
TRPC4, TRPS1, TSC2, TSHZ1, TSHZ2, TSPAN11, TSPAN18, TSPAN2, TSPAN7, TSSK3,
TTC7A, TTC7B, TUBB2C, TUBB3, TUBE1, TXNIP, TXNL1, TXNL4B, TXNRD1, TYW5,
U2SURP, UBAP2L, UBE2D3, UBE2G2, UBE2L3, UBE2V1, UBN2, UBQLN4, UCHL5,
UHMK1, UHRF1BP1L, UNC13B, UNC5B, URGCP, URGCP-MRPS24, USP19, USP7,
USP27X, UVRAG, VANGL1, VARS2, VAV2, VCL, VDAC2, VIM-AS1, VIPAS39,
VPS13A, VPS29, VPS41, VPS51, VSTM2L, VWA8, VWF, WDR19, WDR27, WDR37,
WDR48, WDR90, WDR91, WHSC2, WIPF1, WISP1, WNK1, WNT5B, WNT10B, WSB1,
WWTR1, XDH, XIAP, XRN2, YAP1, YDJC, YES1, YPEL5, YTHDF3, Z24749, ZAK,
ZBTB10, ZBTB24, ZBTB26, ZBTB7A, ZC3H12C, ZC3H14, ZC3H18, ZCCHC5, ZCCHC8,
ZCCHC11, ZEB1, ZEB2, ZFAND1, ZFAND5, ZFP82, ZHX3, ZMIZ1, ZMIZ1-AS1, ZMIZ2,
ZMYM2, ZNF12, ZNF138, ZNF148, ZNF208, ZNF212, ZNF219, ZNF227, ZNF232, ZNF24,
ZNF268, ZNF28, ZNF280D, ZNF281, ZNF335, ZNF350, ZNF37A, ZNF37BP, ZNF395,
ZNF426, ZNF431, ZNF583, ZNF618, ZNF621, ZNF652, ZNF655, ZNF660, ZNF674,
ZNF680, ZNF730, ZNF74, ZNF764, ZNF777, ZNF778, ZNF780A, ZNF7804A, ZNF79,
ZNF827, ZNF836, ZNF837, ZNF839, ZNF91 and ZSCAN25

Table 4 shows certain genes that are expected to demonstrate an effect on inclusion of an iExon or formation of an eExon with a corresponding change in isoform abundance as a result of iExon or eExon generation in RNA having intronic REMS elements in the presence of a compound as described herein. The change in abundance is expected to have a statistically significant p value.

TABLE 4

Table 4

ABCA1, ABCB7, ABCC1, ABHD10, ABL2, ABLIM3, ACACA, ACADVL, ACAT2, ADAM12, ADAM15, ADAM17, ADAM33, AFF2, AGK, AGPAT3, AGPS, AHCYL2, AHDC1, AHRR, AJUBA, AK021888, AK310472, AKAP1, AKAP9, AKNA, ALCAM, ALDH4A1, AMPD2, ANK2, ANKFY1, ANKHD1-EIF4EBP3, ANKRD17, ANKS6, ANP32A, ANXA11, ANXA6, AP2B1, APAF1, APLP2, APP, APPL2, APTX, ARHGAP22, ARID1A, ARID2, ARMCX3, ASAP1, ASL, ASNS, ASPH, ATAD2B, ATF7IP, ATG9A, ATMIN, ATP2C1, ATXN3, AURKA, AXIN1, B4GALT2, BACE1, BAG2, BASP1, BC033281, BCAR3, BEND6, BICD1, BIN1, BNC1, BRD2, BRPF1, BSCL2, BTBD10, BZW1, C11orf30, C11orf73, C17orf76-AS1, C4orf27, C5orf24, C6orf48, C9orf69, CAB39, CALU, CAMKK1, CAPNS1, CASC3, CASP8AP2, CAV1, CCAR1, CCDC77, CCDC88A, CCDC92, CCT6A, CD276, CD46, CDC25B, CDC40, CDC42BPA, CDCA7, CDH11, CDH13, CDK11B, CDK16, CDKAL1, CEP68, CFLAR, CHD8, CIZ1, CLIC1, CLK4, CNOT1, COG1, COL12A1, COL1A1, COL6A1, COPS7B, CPEB2, CREB5, CRLS1, CRTAP, CSDE1, CSNK1A1, CTDSP2, CTNND1, CUL2, CUL4A, CUX1, CYB5B, CYBRD1, CYP51A1, DAB2, DACT1, DAKS, DAXX, DCAF10, DCAF11, DCBLD2, DCUN1D4, DDAH1, DDAH2, DDHD2, DDR1, DDX39B, DDX42, DENND1A, DENND1B, DENND5A, DGCR2, DGKA, DHCR24, DHCR7, DHFR, DHX9, DIAPH1, DIAPH3, DIS3L, DKFZp434M1735, DKK3, DLC1, DNM2, DOCK1, DPP8, DSEL, DST, DSTN, EBF1, EEA1, EEF1A1, EFCAB14, EGR1, EHMT2, EIF2B3, EIF4G1, EIF4G2, EIF4G3, ELF2, ENG, ENPP2, ENSA, EPN1, EPT1, ERC1, ERGIC3, ETV5, EXO1, EXTL2, EYA3, FADS1, FADS2, FAF1, FAM111A FAM198B, FAM219A, FAM219B, FAM3C, FAM65A, FBXO10, FBXO18, FBXO31, FBXO34, FBXO9, FDFT1, FDPS, PER, FEZ1, FGD5-AS1, FGFRL1, FHOD3, FLII, FLNB, FN1, FNBP1, FOCAD, FOS, FOSB, FOSL1, FOXK1, FOXM1, FUS, FYN, GABPB1, GALC, GALNT1, GAS7, GBA2, GCFC2, GGCT, GHDC, GIGYF2, GJC1, GMIP, GNA13, GNAS, GNL3L, GOLGA2, GOLGA4, GOLGB1, GORASP1, GPR1, GPR89A, GPSM2, GREM1, GRK6, GSE1, GTF2H2B, HAS2, HAT1, HAUS3, HAUS6, HDAC7, HEG1, HLA-A, HLA-E, HLTF, HMGA1, HMGB1, HMGCR, HMGCS1, HMOX1, HNRNPR, HNRNPL1, HP1BP3, HRH1, HSD17B12, HSD17B4, HTT, IARS, IDH1, IDI1, IGF2BP2, IL6ST, INHBA, INSIG1, IQCE, ITGAV, ITGB5, ITM2C, ITSN1, KANSL3, KCNK2, KIAA1033, KIAA1143, KIAA1199, KIAA1522, KIAA1524, KIAA1549, KIAA1715, KIF14, KIF2A, KIF3A, KLC1, KLC2, KLF6, KLHL7, KRT18, KRT19, KRT34, KRTAP2-3, LAMA2, LAMB1, LARP4, LARP7, LATS2, LDLR, LEMD3, LGALS8, LIMS1, LINC00341, LINC00657, LMAN2L, LMO7, LONP1, LOX, LRCH4, LRIG1, LRP8, LRRC8A, LSS, LTBR, LUC7L2, LZTS2, MADD, MAGED4, MAGED4B, MAN1A2, MAP4K4, MBD1, MBOAT7, MDM2, MED1, MEDAG, MEF2D, MEIS2, MEMO1, MEPCE, MFGE8, MICAL2, MINPP1, MKL1, MKLN1, MKNK2, MLLT4, MLST8, MMAB, MMS19, MMS22L, MPPE1, MPZL1, MRPL3, MSANTD3, MSC, MSH2, MSH6, MSL3, MEMO1, MSRB3, MTAP, MTERFD1, MTHFD1L, MTMR9, MTRR, MUM1, MVD, MVK, MYADM, MYLK, MYO1D, MYO9B, MYOF, NAA35, NADK, NASP, NAV1, NAV2, NCOA1, NCOA3, NCOA4, NCSTN, NELFA, NEO1, NEURL1B, NF2, NFE2L1, NFX1, NID1, NID2, NIPA1, NKX3-1, NOL10, NOMO3, NPEPPS, NRD1, NREP, NRG1, NSUN4, NT5C2, NT5E, NTNG1, NUDT4, NUP153, NUP35, NUP50, NUPL1, NUSAP1, ODF2, OS9, OSBPL6, OSMR, P4HA1, P4HB, PABPC1, PAK4, PAPD4, PARD3, PARN, PARP14, PARP4, PARVB, PCBP2, PCBP4, PCDHGB3, PCGF3, PCM1, PCMTD2, PCNXL2, PCSK9, PDE4A, PDE7A, PDLIM7, PDXDC1, PEPD, PEX5, PFKP, PHF19, PHF8, PHRF1, PHTF2, PI4K2A, PIEZO1, PIGU, PIK3C2B, PITPNA, PITPNB, PITPNM1, PLAU, PLEC, PLEKHB2, PLSCR3, PLXNB2, PLXNC1, PMS1, POLE3, POLR3D, POSTN, POU2F1, PPAPDC1A, PPARA, PPHLN1, PPIP5K1, PPP1R12A, PPP6R1, PPP6R2, PRKACB, PRKDC, PRMT1, PRNP, PRSS23, PSMA4, PSMC1, PSMD6, PTK2B, PTPN14, PUF60, PUS7, PVR, PXN, QKI, RAB23, RAB2B, RAB34, RAD1, RAD23B, RALB, RAP1A, RAP1GDS1, RARG, RASSF8, RBCK1, RBFOX2, RBM10, RCC1, RFTN1, RFWD2, RGS10, RGS3, RIF1, RNF14, RNF19A, RNF38, RNFT1, RPL10, RPS6KC1, RRBP1, RWDD4, SAMD9, SAMD9L, SAR1A, SART3, SCAF4, SCAF8, SCD, SCLT1, SCO1, SDCBP, SEC14L1, SEC22A, SEC24B, SEC61A1, SEPT9, SERPINE2, SF1, SGOL2, SH3RF1, SKIL, SLC25A17, SLC39A3, SLC41A1, SLC4A4, SLC7A6, SLC7A8, SMARCA4, SMARCC2, SMC4, SMC6, SMCHD1, SMG1, SMN2, SMPD4, SMYD3, SMYD5, SNAP23, SNHG16, SNX14, SOCS2, SON, SOS2, SPATA20, SPATS2, SPG20, SPRED2, SQLE, SQRDL, SQSTM1, SRCAP, SREBF1, SREK1, SRSF3, STARD4, STAT1, STAT3, STAU1, STC2, STEAP2, STRIP1, STRN3, STX16, SUPT20H, SYNE1, SYNE2, SYT15, SYTL2, TACC1, TAF2, TANC2, TARBP1, TARS, TBC1D15, TBL2, TCF7L2, TENC1, TENM2, TEP1, TET3, TFCP2, TGFBI, TGFBR1, TGFBRAP1, THADA, THAP4, THRB, TIMP2, TJP2, TLE3, TLK1, TMEM154, TMEM47, TMEM63A, TNC, TNFAIP3, TNFRSF12A, TNIP1, TNKS1BP1, TNPO3, TNS1, TNS3, TOE1, TOMM40, TOMM5, TOPORS, TP53INP1, TRAF3, TRAK1, TRAPPC12, TRIB1, TRIM2, TRIM23, TRIM26, TRIM28, TRIM65, TRMT1L, TRPS1, TSC2, TSHZ1, TSPAN2, TTC7A, TUBB2C, TUBB3, TXNL1, TXNRD1, U2SURP, UBAP2L, UBE2G2, UBE2V1, UBQLN4, UCHL5, UHMK1, UHRF1BP1L, UNC5B, USP19, USP7, VANGL1, VARS2, VCL, VIPAS39, VPS13A, VPS29, VPS51, VWA8, WDR19, WDR37, WDR48, WIPF1, WNT5B, WSB1, WWTR1, XIAP, XRN2, YAP1, YES1, YPEL5, YTHDF3, Z24749, ZAK, ZBTB10, ZBTB24, ZBTB7A, ZC3H12C, ZC3H14, ZC3H18, ZCCHC11, ZEB1, ZEB2, ZFAND1, ZFAND5, ZHX3, ZMIZ1, ZMYM2, ZNF12, ZNF148, ZNF219, ZNF227, ZNF24, ZNF268, ZNF28, ZNF281, ZNF335, ZNF37A, ZNF37BP, ZNF395, ZNF583, ZNF621, ZNF652, ZNF655, ZNF674, ZNF74, ZNF764, ZNF778, ZNF780A, ZNF827, ZNF839 and ZNF91

Table 5 shows certain genes that are expected to demonstrate an effect on inclusion of an iExon or formation of an eExon with a corresponding change in isoform abundance as a result of iExon or eExon generation in RNA having intronic REMS elements in the presence of a compound as described herein. The change in abundance is expected to have a statistically significant p value.

eExon with a corresponding change in isoform abundance as a result of iExon or eExon generation in RNA having intronic REMS elements in the presence of a compound as described herein. The change in abundance is expected to have a statistically significant p value.

TABLE 5

Table 5

ABCA1, ABCC1, ABL2, ACACA, ACAT2, AFF2, AHRR, AK021888, AK310472, AKAP1, ANK2, ANKHD1-EIF4EBP3, AP2B1, APAF1, APLP2, ARID1A, ARMCX3, ASAP1, ASPH, ATAD2B, ATF7IP, ATG9A, AXIN1, BACE1, BIN1, BNC1, BRPF1, BZW1, C11orf30, C11orf73, C17orf76-AS1, C4orf27, C6orf48, CAB39, CAMKK1, CCDC88A, CCDC92, CDC25B, CDC42BPA, CDCA7, CDH11, CDH13, CEP68, CFLAR, COPS7B, CREB5, CUL2, CUL4A, CUX1, CYP51A1, DCUN1D4, DDR1, DDX39B, DDX42, DENND1A, DENND5A, DGKA, DHCR24, DHCR7, DIAPH1, DIAPH3, DNM2, DOCK1, EFCAB14, EIF2B3, EPN1, EPT1, ERC1, ETV5, FADS1, FADS2, FAF1, FAM198B, FAM219B, FBXO10, FBXO9, FDFT1, FDPS, FER, FEZ1, FHOD3, FLII, FLNB, FNBP1, FOS, FOSB, FOXM1, FYN, GABPB1, GALC, GAS7, GGCT, GJC1, GPSM2, GRK6, HAS2, HAT1, HLTF, HMGA1, HMGB1, HMGCR, HMGCS1, HMOX1, HP1BP3, HSD17B12, HTT, IDI1, INHBA, INSIG1, KANSL3, KIAA1199, KIAA1524, KIAA1715, KIF3A, KLF6, KRT19, KRT34, KRTAP2-3, LAMA2, LARP7, LDLR, LEMD3, LMAN2L, LRCH4, LRP8, LSS, MAGED4, MAGED4B, MAN1A2, MEDAG, MEF2D, MEMO1, MFGE8, MICAL2, MMAB, MMS19, MMS22L, MSL3, MSMO1, MTAP, MTERFD1, MVD, MVK, NASP, NAV2, NEURL1B, NFE2L1, NID1, NPEPPS, NREP, NRG1, NSUN4, NT5C2, NUP153, P4HA1, PABPC1, PAPD4, PCBP2, PCM1, PCSK9, PDXDC1, PEPD, PHF19, PHF8, PHTF2, PIK3C2B, PITPNB, PLEC, PMS1, POU2F1, PPHLN1, PRKDC, PRSS23, PSMC1, PTPN14, PUF60, PVR, RAB23, RAD23B, RAP1A, RASSF8, RBM10, RCC1, RFWD2, RNFT1, RWDD4, SAMD9L, SART3, SCAF4, SCD, SEC22A, SEC61A1, SERPINE2, SF1, SLC25A17, SLC7A6, SLC7A8, SMN2, SMYD3, SMYD5, SNAP23, SNHG16, SQLE, SQRDL, SQSTM1, SRCAP, SREBF1, STARD4, STAT1, STAU1, STEAP2, STRN3, SYNE1, TACC1, TAF2, TANC2, TARBP1, TBC1D15, TEP1, TFCP2, TGFBRAP1, THADA, TIMP2, TLK1, TMEM154, TNS3, TOMM5, TRAF3, TRAK1, TRAPPC12, TRIM2, TRIM26, TRIM65, TSPAN2, U2SURP, UBAP2L, UBE2V1, UCHL5, UHRF1BP1L, VANGL1, VARS2, VPS13A, VPS29, VWA8, WSB1, XIAP, XRN2, YPEL5, ZAK, ZC3H18, ZFAND5, ZMIZ1, ZMYM2, ZNF219, ZNF227, ZNF24, ZNF37A, ZNF37BP, ZNF395, ZNF652, ZNF674, ZNF74 and ZNF778

Table 6 shows certain genes that are expected to demonstrate an effect on inclusion of an iExon or formation of an eExon with a corresponding change in isoform abundance as a result of iExon or eExon generation in RNA having intronic REMS elements in the presence of a compound as described herein. The change in abundance is expected to have a statistically significant p value.

TABLE 6

Table 6

ABCC1, ACADVL, ADAM15, AGPAT3, AHRR, AJUBA, AKAP1, AKAP9, ALCAM, ALDH4A1, ANKFY1, AP2B1, APLP2, APP, ARID1A, ARID2, ASPH, ATMIN, BASP1, BC033281, BCAR3, C11orf73, C17orf76-AS1, C5orf24, C6orf48, CAB39, CASP8AP2, CAV1, CCAR1, CCT6A, CD276, CD46, CDC25B, CDK16, CEP68, CHD8, CLIC1, COL12A1, CPEB2, CREB5, CRLS1, CRTAP, CTNND1, CUX1, CYBRD1, DACT1, DCAF10, DCAF11, DDHD2, DDX39B, DIAPH3, DKK3, DLC1, DSTN, EBF1, EGR1, EIF4G1, EIF4G3, ENG, ERC1, ETV5, FAM198B, FAM219A, FAM3C, FEZ1, FGD5-AS1, FLII, FN1, FNBP1, FOS, FOSB, FOXK1, FOXM1, FYN, GABPB1, GALC, GALNT1, GBA2, GGCT, GHDC, GMIP, GNA13, GNAS, GNL3L, GOLGA2, GORASP1, GREM1, GSE1, HAUS6, HDAC7, HEG1, HLA-A, HLA-E, HMGA1, HP1BP3, IL6ST, ITGAV, KIAA1549, KIF14, KLC1, KLF6, KLHL7, KRT18, LAMA2, LAMB1, LARP7, LATS2, LGALS8, LIMS1, LINC00341, LONP1, LOX, MDM2, MEPCE, MINPP1, MLLT4, MPPE1, MRPL3, MSH2, MSH6, MSL3, MTMR9, MTRR, MUM1, MYADM, MYLK, NADK, NAV2, NCSTN, NFE2L1, NID1, NIPA1, NPEPPS, NRD1, NUDT4, NUSAP1, P4HB, PABPC1, PAK4, PAPD4, PCNXL2, PDE4A, PDXDC1, PHRF1, PHTF2, PI4K2A, PIK3C2B, PLAU, PLEKHB2, PLSCR3, PLXNB2, POSTN, POU2F1, PPARA, PPP1R12A, PRKACB, PSMD6, PTPN14, PUS7, QKI, RAB34, RAD1, RAD23B, RASSF8, RBCK1, RBFOX2, RFTN1, RNF19A, RNF38, RPS6KC1, RWDD4, SEC14L1, SEC24B, SERPINE2, SF1, SLC39A3, SLC41A1, SLC4A4, SLC7A6, SMARCA4, SMN2, SNHG16, SNX14, SON, SPRED2, STAU1, STEAP2, STRIP1, STRN3, TBL2, TGFB1, TGFBR1, THAP4, TLE3, TMEM47, TNKS1BP1, TOMM40, TOPORS, TRAK1, TRAPPC12, TRIB1, TRIM2, TRIM23, TRIM65, TRMT1L, TRPS1, TXNL1, TXNRD1, U2SURP, UBE2G2, UBE2V1, UHMK1, USP7, VPS29, VWA8, WDR19, WDR37, WIPF1, YPEL5, YTHDF3, Z24749, ZBTB10, ZBTB7A, ZFAND5, ZMIZ1, ZNF12, ZNF148, ZNF335, ZNF395, ZNF583, ZNF621, ZNF655, ZNF74 and ZNF780A Table 7 shows certain genes that are expected to demonstrate an effect on inclusion of an iExon or formation of an

TABLE 7

Table 7

ABCB7, ABHD10, ABLIM3, ACACA, ADAM12, ADAM17, ADAM33, AGK, AGPS,
AHCYL2, AHDC1, AHRR, AK021888, AK310472, AKAP1, AKAP9, AKNA, AMPD2,
ANKRD17, ANKS6, ANP32A, ANXA11, ANXA6, APLP2, APP, APPL2, APTX,
ARHGAP22, ARMCX3, ASAP1, ASNS, ASPH, ATG9A, ATP2C1, AURKA, AXIN1,
B4GALT2, BACE1, BASP1, BEND6, BICD1, BIN1, BRD2, BRPF1, BTBD10, C11orf30,
C11orf73, C17orf76-AS1, C4orf27, C6orf48, CAB39, CAPNS1, CASC3, CCDC77,
CCDC88A, CD46, CDC40, CDC42BPA, CDCA7, CDH13, CDK11B, CEP68, CIZ1, CLK4,
CNOT1, COG1, COL12A1, COL1A1, COL6A1, COPS7B, CSDE1, CSNK1A1, CUX1,
CYB5B, CYBRD1, DAB2, DARS, DCBLD2, DCUN1D4, DDAH2, DDR1, DDX39B,
DDX42, DENND1A, DENND1B, DENND5A, DGKA, DHFR, DHX9, DIAPH1, DIAPH3,
DIS3L, DNM2, DOCK1, DPP8, DSEL, EEA1, EFCAB14, EIF2B3, EIF4G1, EIF4G3, ELF2,
ENG, ENPP2, EPN1, EXTL2, EYA3, FAF1, FAM198B, FAM3C, FBXO10, FBXO18,
FBXO31, FBXO9, FER, FEZ1, FHOD3, FLII, FN1, FNBP1, FOCAD, FOSL1, FOXM1,
GABPB1, GALC, GALNT1, GCFC2, GGCT, GIGYF2, GMIP, GNAS, GNL3L, GOLGB1,
GPR89A, GPSM2, GREM1, GRK6, GTF2H2B, HAT1, HAUS3, HEG1, HLA-A, HLTF,
HP1BP3, HRH1, HSD17B12, HSD17B4, HTT, IARS, IDH1, IGF2BP2, ITM2C, KCNK2,
KIAA1033, KIAA1143, KIAA1522, KIAA1524, KIAA1715, KIF3A, KLHL7, LAMA2,
LARP4, LARP7, LATS2, LIMS1, LINC00341, LINC00657, LMAN2L, LMO7, LRCH4,
LRIG1, LRRC8A, LTBR, LUC7L2, LZTS2, MADD, MAGED4B, MAN1A2, MAP4K4,
MED1, MEDAG, MEF2D, MEIS2, MEMO1, MICAL2, MKLN1, MLLT4, MMS19,
MPZL1, MSANTD3, MSC, MSL3, MTAP, MTERFD1, MTHFD1L, MYADM, MYLK,
MYO9B, MYOF, NASP, NAV2, NCOA3, NCOA4, NELFA, NEO1, NEURL1B, NF2,
NID2, NOL10, NPEPPS, NRG1, NSUN4, NT5C2, NT5E, NTNG1, NUP153, NUP35,
NUP50, NUSAP1, ODF2, OS9, OSBPL6, P4HA1, P4HB, PABPC1, PAPD4, PARN,
PARP4, PCBP2, PCBP4, PCDHGB3, PCGF3, PCM1, PCMTD2, PDE7A, PDXDC1, PEPD,
PFKP, PHF19, PHRF1, PHTF2, PIEZO1, PIGU, PITPNA, PITPNB, PITPNM1, PLAU,
PLSCR3, PLXNC1, PMS1, POU2F1, PPAPDC1A, PPHLN1, PPIP5K1, PPP1R12A,
PRKDC, PRMT1, PRSS23, PSMA4, PTK2B, PUF60, PVR, RAB23, RAB2B, RAD1,
RAD23B, RAP1A, RAP1GDS1, RARG, RASSF8, RBCK1, RCC1, RFWD2, RGS3, RNF14,
RNFT1, RPL10, RRBP1, RWDD4, SAR1A, SCAF4, SCAF8, SCLT1, SCO1, SDCBP,
SEC22A, SEPT9, SF1, SGOL2, SLC25A17, SLC4A4, SLC7A6, SMARCC2, SMC4, SMC6,
SMCHD1, SMN2, SMPD4, SMYD3, SNAP23, SNHG1, SOCS2, SOS2, SPATA20,
SPATS2, SPG20, SQRDL, SREBF1, SREK1, SRSF3, STAT1, STAU1, STEAP2, STRN3,
STX16, SUPT20H, SYNE1, SYNE2, SYT15, SYTL2, TAF2, TARBP1, TARS, TBL2,
TCF7L2, TENC1, TENM2, TEP1, TET3, TGFBR1, THADA, THRB, TJP2, TLE3,
TMEM47, TMEM63A, TNFAIP3, TNIP1, TNPO3, TNS1, TNS3, TOE1, TOMM5,
TP53INP1, TRAF3, TRAPPC12, TRIM2, TRIM23, TRIM65, TSC2, TSPAN2, TUBB2C,
TXNRD1, UBAP2L, UBE2V1, UCHL5, USP19, VANGL1, VIPAS39, VPS29, VPS51,
VWA8, WDR48, WNT5B, WSB1, WWTR1, XRN2, YAP1, YES1, YPEL5, YTHDF3,
Z24749, ZBTB24, ZC3H14, ZFAND1, ZFAND5, ZHX3, ZMIZ1, ZMYM2, ZNF219,
ZNF268, ZNF395, ZNF827 and ZNF91

Table 8 shows certain genes that are expected to demonstrate an effect on inclusion of an iExon or formation of an eExon with a corresponding change in isoform abundance as a result of iExon or eExon generation in RNA having intronic REMS elements in the presence of a compound as described herein. The change in abundance is expected to have a statistically significant p value.

TABLE 8

Table 8

ACACA, ACADVL, AFF2, AHCYL2, AHRR, AKAP1, ALDH4A1, ANKRD17, AP2B1,
APLP2, ASL, ASPH, ATG9A, ATMIN, ATXN3, BAG2, BASP1, BRPF1, BSCL2,
C11orf30, C11orf73, C17orf76-AS1, C6orf48, C9orf69, CAB39, CALU, CDC25B,
CDC42BPA, CDKAL1, CLIC1, COL12A1, COL1A1, COL6A1, CSNK1A1, CTDSP2,
CUL2, CUL4A, DAXX, DCAF10, DDAH1, DDR1, DDX39B, DENND1A, DGCR2,
DKFZp434M1735, DKK3, DNM2, DST, EEF1A1, EFCAB14, EHMT2, EIF4G1, EIF4G2,
EIF4G3, ENSA, EXO1, FAM111A, FAM198B, FAM65A, FBXO34, FEZ1, FGD5-AS1,
FGFRL1, FLII, FN1, FOXK1, FOXM1, FUS, GALC, GALNT1, GAS7, GCFC2, GGCT,
GJC1, GNA13, GNL3L, GOLGA4, GPR1, GREM1, HEG1, HLA-A, HLA-E, HLTF,
HNRNPR, HNRNPUL1, IQCE, ITGB5, ITSN1, KIAA1033, KIF2A, KIF3A, KLC2, LATS2,
LIMS1, LINC00341, LINC00657, LONP1, LOX, LUC7L2, MBD1, MBOAT7, MEF2D,
MEIS2, MICAL2, MKL1, MKNK2, MLST8, MPPE1, MSL3, MSRB3, MTRR, MYADM,
MYLK, MYO1D, NAA35, NAV1, NAV2, NCOA1, NFX1, NKX3-1, NOMO3, NRG1,
NUDT4, NUPL1, NUSAP1, OSMR, P4HA1, P4HB, PAPD4, PARD3, PARN, PARP14,
PARVB, PCBP2, PCBP4, PCGF3, PDLIM7, PDXDC1, PEX5, PFKP, PHRF1, PI4K2A,
POLE3, POLR3D, POSTN, PPARA, PPP6R1, PPP6R2, PRNP, PXN, RAB34, RAD23B,
RALB, RAP1A, RASSF8, RBCK1, RBFOX2, RGS10, RIF1, RNF14, RNF19A, SAMD9,
SCAF4, SDCBP, SERPINE2, SF1, SH3RF1, SKIL, SLC25A17, SLC4A4, SMG1, SMN2,
SNHG16, SREBF1, STAT5, STC2, STEAP2, STRN3, SYNE1, SYNE2, TACC1, TARS,
TGFBI, TMEM47, TNC, TNFRSF12A, TNS1, TRAF3, TRIM28, TSC2, TSHZ1, TTC7A,
TUBB2C, TUBBS, TXNL1, TXNRD1, UBE2G2, UBE2V1, UBQLN4, UNC5B, USP19,
VARS2, VCL, VPS29, WDR37, WIPF1, WWTR1, ZC3H12C, ZCCHC11, ZEB1, ZEB2,
ZFAND1, ZFAND5, ZMIZ1, ZNF28, ZNF281, ZNF655, ZNF764 and ZNF839

Table 9 shows certain genes that are expected to demonstrate an effect on inclusion of an iExon or formation of an eExon with a corresponding change in isoform abundance as a result of iExon or eExon generation in RNA having intronic REMS elements in the presence of a compound as described herein. The change in abundance is expected to have a statistically significant p value.

corresponding change in isoform abundance as a result of iExon or eExon generation in RNA having an intronic REMS sequence in cells treated with Compound 64 (24 nm and 100 nm) resulting in a statistically significant adjusted Fisher's Exact Test p value.

TABLE 9

| Table 9 |
|---|
| ABCB8, ABCC3, ADAM17, ADCY3, AGPAT4, ANKRA2, ANXA11, APIP, APLP2, ARHGAP1, ARL15, ASAP1, ASPH, ATAD2B, ATXN1, AXIN1, BECN1, BHMT2, BICD1, BTN3A1, C11orf30, C11orf73, C12orf4, C14orf132, C8orf44, C8orf44-SGK3, C8orf88, CASC3, CASP7, CCDC122, CDH13, CECR7, CENPI, CEP112, CEP192, CHEK1, CMAHP, CNRIP1, COPS7B, CPSF4, CRISPLD2, CRYBG3, CSNK1E, CSNK1G1, DAGLB, DCAF17, DCUN1D4, DDX42, DENND1A, DENND5A, DGKA, DHFR, DIAPH3, DLGAP4, DNAJC13, DNMBP, DOCK1, DYRK1A, EIF2B3, ENAH, ENOX1, EP300, ERC1, ERCC1, ERGIC3, ERLIN2, ERRFI1, EVC, FAF1, FAIM, FAM126A, FAM13A, FAM162A, FAM174A, FAM198B, FBN2, FER, FHOD3, FOCAD, GALC, GCFC2, GGACT, GGCT, GLCE, GOLGA4, GOLGB1, GPSM2, GULP1, GXYLT1, HAT1, HDX, HLTF, HMGA2, HNMT, HPS1, HSD17B12, HSD17B4, HTT, IFT57, INPP5K, IVD, KDM6A, KIAA1524, KIAA1715, LETM2, LOC400927, LRRC42, LUC7L3, LYRM1, MADD, MB21D2, MCM10, MED13L, MEDAG, MEMO1, MFN2, MMS19, MRPL45, MRPS28, MTERF3, MYCBP2, MYLK, MYOF, NGF, NREP, NSUN4, NT5C2, OSMR, OXCT1, PAPD4, PCM1, PDE7A, PDS5B, PDXDC1, PIGN, PIK3CD, PIK3R1, PIKFYVE, PITPNB, PLEKHA1, PLSCR1, PMS1, POMT2, PPARG, PPHLN1, PPIP5K2, PPP1R26, PRPF31, PRSS23, PRUNE2, PSMA4, PXK, RAFI, RAP1A, RAPGEF1, RARS2, RBKS, RERE, RFWD2, RNFT1, RPA1, RPS10, RPS6KB2, SAMD4A, SAR1A, SCO1, SEC24A, SENP6, SERGEF, SGK3, SH3YL1, SKA2, SLC12A2, SLC25A17, SLC44A2, SMYD3, SNAP23, SNHG16, SNX7, SOS2, SPATA18, SPATA5, SPIDR, SPRYD7, SRGAP1, SRRM1, STAT1, STRN3, STXBP6, SUPT20H, TAF2, TASP1, TBC1D15, TCF12, TCF4, TIAM1, TJP2, TMC3, TMEM189-UBE2V1, TMEM214, TNRC6A, TNS3, TOE1, TRAF3, TRIM65, TSPAN2, TTC7B, TUBE1, TYW5, UBAP2L, UBE2V1, URGCP, VAV2, VPS29, WDR27, WDR37, WDR91, WNK1, XRN2, ZCCHC8, ZFP82, ZNF138, ZNF232, ZNF37BP and ZNF680 |

Table 10 shows genes that demonstrate an effect on inclusion of an iExon or formation of an eExon with a

TABLE 10

| Table 10 |
|---|
| ABHD10, ADAL, ADAM17, ADAM23, ADAMTS19, AGPAT4, AGPS, AKAP8L, AKT1, ANKRD13C, ANXA11, APIP, APOA2, APPL2, ARHGAP1, ARHGAP5, ARL15, ARL5B, ARSJ, ASAP1, ATF6, BECN1, BHMT2, BIN3, BNC2, BRCA1, BRCA2, BTBD10, C1QTNF9B-AS1, C1ORF27, C11ORF30, C11ORF73, C11ORF76, C12ORF4, C2ORF47, CACNB1, CACNB4, CADM2, CCNL2, CDH18, CDKN1C, CENPI, CEP162, CEP170, CEP192, CEP57, CHEK1, CHRM2, CMAHP, CMSS1, CNOT7, CNRIP1, CNTN1, COPS7B, CRISPLD2, CRX, CRYBG3, CTRC, CUX1, DAAM1, DCAF17, DCUN1D4, DDX42, DENND1A, DENND4A, DENND5A, DET1, DGK1, DHFR, DIAPH3, DLG5, DMXL1, DMD, DNAH11, DNAJA4, DNMBP, DYRK1A, DZIP1L, EIF2B3, ELMO2, ENAH, ENOX1, EP300, ERC1, ERC2, EVC, EXOC3, EXOC6B, FAM162A, FAM174A, FAM195B, FAM208B, FAM49B, FAM69B, FBN2, FBXL16, FBXO9, FGD4, FHOD3, GALC, GBP1, GLCE, GNG12, GOLGB1, GTSF1, GXYLT1, HDAC5, HDX, HMGXB4, HOXB3, HPS1,, HSD17B4, HTT, IFT57, IKBKAP, INO80, IPP4B, INVS, ITCH, IVD, KDM6A, KDSR, KIAA1524, KIAA1715, KIDINS220, KIF21A, L3MBTL2, LGALS3, LINCR-0002, LINGO2, LMNA, LOC400927, LPHN1, LRRC1, LRRC42, LYRM1, MACROD2, MANEA, MAPK10, MARCH7, MARCH8, MDN1, MEAF6, MECP2, MEMO1, MFN2, MLLT10, MMS19, MORF4L1, MRPL39, MRPL45, MRPS28, MTMR3, MYB, MYCBP2, MYLK, NEDD4, NFASC, NGF, NIPA1, NLGN1, NLN, NREP, NSUN4, NUPL1, OSBPL3, PAPD4, PAX6, PBX3, PCCB, PCDH10, PDE3A, PDE7A, PDXDC1, PDXDC2P, PELI1, PIGN, PITPNB, PMS1, PNISR, POMT2, PPARG, PPFIBP1, PRPF31, PSMA4, PTCH1, PXK, RAB23, RAF1, RAPGEF1, RASIP1, RBBP8, RCOR3, RERE, RGL1, RNF130, RNF144A, RNF213, RPF2, RPS10, SAMD4A, SCO1, SENP6, SF3B3, SGIP1, SGMS1, SGPL1, SH2B3, SKP1, SLC12A2, SLC25A16, SLC25A17, SLC34A3, SMN2, SMOX, SNAP23, SNX24, SNX7, SOCS6, SOGA2, SORCS1, SPIDR, SPINK5, SPRYD7, SREK1, SSBP1, STRAD8, STXBP4, STXBP6, SUPT20H, TAF2, TARBP1, TASP1, TBCA, TBL1XR1, TCF4, TEKT4P2, TET1, TIAM1, TJAP1, TJP2, TMEM67, TMEM214, TMX3, TNRC6A TRAF3, TRIM65, TSPAN7, TXNL4B, UBE2D3, UBE2L3, UBN2, UNC13B, URGCP-MRPS24, UVRAG, VDAC2, VWF, WDR27, WDR90, WHSC2, WNK1, XDH, XRN2, ZFP82, ZMIZ2, ZNF138, ZNF208, ZNF212, ZNF280D, ZNF350, ZNF37BP, ZNF426, ZNF618, ZNF680, ZNF730, ZNF777, ZNF7804A, ZNF836 and ZSCAN25 |

Table 11 shows certain genes that are expected to demonstrate an effect on inclusion of an iExon or formation of an eExon with a corresponding change in isoform abundance as a result of iExon or eExon generation in RNA having intronic REMS elements in the presence of a compound as described herein. The change in abundance is expected to have a statistically significant p value.

TABLE 11

| Table 11 |
|---|
| APOA2, ASAP1, BRCA1, BRCA2, CDKN1C, CRX, CTRC, DENND5A, DIAPH3, DMD, DNAH11, EIF2B3, GALC, HPS1, HTT, IKBKAP, KIAA1524, LMNA, MECP2, PAPD4, PAX6, PCCB, PITPNB, PTCH1, SLC34A3, SMN2, SPINK5, SREK1, TMEM67, VWF, XDH and XRN2 |

Table 12 shows certain genes that are expected to demonstrate an effect on inclusion of an iExon or formation of an eExon with a corresponding change in isoform abundance as a result of iExon or eExon generation in RNA having intronic REMS elements in the presence of a compound as described herein. The change in abundance is expected to have a statistically significant p value.

TABLE 12

Table 12

ABCA1, ABCA10, ABCB7, ABCB8, ABCC1, ABCC3, ABL2, ABLIM3, ACACA,
ACADVL, ACAT2, ACTA2, ADAL, ADAM15, ADAM17, ADAM23, ADAM33,
ADAMTS1, ADAMTS19, ADCY3, ADD1, ADGRG6, ADH6, ADHFE1, AFF2, AFF3,
AGK, AGPAT3, AGPAT4, AGPS, AHCYL2, AHDC1, AHRR, AJUBA, AK021888,
AK310472, AKAP1, AKAP3, AKAP8L, AKAP9, AKNA, ALCAM, ALDH4A1, AMPD2,
ANK1, ANK2, ANK3, ANKFY1, ANKHD1-EIF4EBP3, ANKRA2, ANKRD13C,
ANKRD17, ANKRD33B, ANKRD36, ANKS6, ANP32A, ANXA6, AP2B1, AP4B1-AS1,
APAF1, APIP, APOA2, APP, APTX, ARHGAP1, ARHGAP12, ARHGAP22, ARHGAP5,
ARHGEF16, ARID1A, ARID2, ARID5B, ARL9, ARL15, ARL5B, ARMCX3, ARSJ,
ASAP1, ASIC1, ASL, ASNS, ASPH, ATAD2B, ATF6, ATF7IP, ATG9A, ATMIN, ATP2A3,
ATP2C1, ATXN1, ATXN3, AURKA, B3GALT2, B3GNT6, B4GALT2, BACE1, BAG2,
BASP1, BC033281, BCAR3, BCL2L15, BCYRN1, BECN1, BEND6, BHMT2, BICD1,
BIN1, BIN3, BIN3-IT1, BIRC3, BIRC6, BNC1, BNC2, BRCA1, BRCA2, BRD2, BRPF1,
BSCL2, BTBD10, BTG2, BTN3A1, BZW1, C1QTNF9B-AS1, C1orf27, C1orf86, C10orf54,
C11orf30, C11orf70, C11orf73, C11orf76, C11orf94, C12orf4, C12orf56, C14orf132,
C17orf76-AS1, C19orf47, C2orf47, C3, C4orf27, C5orf24, C6orf48, C7orf31, C8orf34,
C8orf44, C8orf44-SGK3, C8orf88, C9orf69, CA13, CA3, CAB39, CACNA2D2, CACNB1,
CACNB4, CADM1, CADM2, CALU, CAMKK1, CAND2, CAPNS1, CASC3, CASP7,
CASP8AP2, CAV1, CCAR1, CCDC77, CCDC79, CCDC88A, CCDC92, CCDC122, CCER2,
CCNF, CCNL2, CCT6A, CD276, CD46, CDC25B, CDC40, CDC42BPA, CDCA7, CDH11,
CDH13, CDH18, CDK11B, CDK16, CDKAL1, CDKN1C, CECR7, CELSR1, CEMIP,
CENPI, CEP112, CEP162, CEP170, CEP192, CEP68, CFH, CFLAR, CHD8, CHEK1,
CHRM2, CIITA, CIZ1, CLDN23, CLIC1, CLK4, CLTA, CMAHP, CNGA4, CNOT1,
CNRIP1, CNTD1, CMSS1, CNOT7, CNRIP1, CNTN1, COG1, COL1A1, COL11A1,
COL12A1, COL14A1, COL15A1, COL5A1, COL5A3, COL6A1, COL6A6, COL8A1,
COLEC12, COMP, COPS7B, CPA4, CPEB2, CPQ, CPSF4, CREB5, CRISPLD2, CRLF1,
CRLS1, CRTAP, CRX, CRYBG3, CRYL1, CSDE1, CSNK1A1, CSNK1E, CSNK1G1,
CTDSP2, CTNND1, CTRC, CUL2, CUL4A, CUX1, CYB5B, CYB5R2, CYBRD1, CYGB,
CYP1B1, CYP51A1, DAAM1, DAB2, DACT1, DAGLB, DARS, DAXX, DCAF10,
DCAF11, DCAF17, DCBLD2, DCLK1, DCN, DCUN1D4, DDAH1, DDAH2, DDHD2,
DDIT4L, DDR1, DDX39B, DDX42, DDX50, DEGS1, DENND1A, DENND1B, DENND4A,
DENND5A, DEBTOR, DET1, DFNB59, DGCR2, DGK1, DGKA, DHCR24, DHCR7, DHFR,
DHX9, DIAPH1, DIAPH3, DIRAS3, DIS3L, DKFZp434M1735, DKK3, DLC1, DLG5,
DMD, DMXL1, DNAH8, DNAH11, DNAJA4, DNAJC13, DNAJC27, DNM2, DNMBP,
DOCK1, DOCK11, DPP8, DSEL, DST, DSTN, DYNC1I1, DYRK1A, DZIP1L, EBF1,
EEA1, EEF1A1, EFCAB14, EFEMP1, EGR1, EGR3, EHMT2, EIF2B3, EIF4G1, EIF4G2,
EIF4G3, ELF2, ELMO2, ELN, ELP4, EMX2OS, ENAH, ENG, ENOX1, ENPP1, ENPP2,
ENSA, EP300, EPT1, ERC1, ERC2, ERCC1, ERCC8, ERLIN2, ERRFI1, ESM1, ETV5,
EVC, EVC2, EXO1, EXOC3, EXOC6B, EXTL2, EYA3, F2R, FADS1, FADS2, FAF1,
FAIM, FAM111A, FAM126A, FAM13A, FAM160A1, FAM162A, FAM174A, FAM195B,
FAM198B, FAM20A, FAM208B, FAM219A, FAM219B, FAM3C, FAM46B, FAM49B,
FAM65A, FAM65B, FAM69B, FAP, FARP1, FBLN2, FBN2, FBXL16, FBXL6, FBXO9,
FBXO10, FBXO18, FBXO31, FBXO34, FBXO9, FCHO1, FDFT1, FDPS, FER, FEZ1,
FGD4, FGD5-AS1, FGFR2, FGFRL1, FGL2, FHOD3, FLII, FLNB, FLT1, FN1, FNBP1,
FOCAD, FOS, FOSB, FOSL1, FOXK1, FRAS1, FSCN2, FUS, FYN, GABPB1, GAL3ST4,
GALC, GALNT1, GALNT15, GAS7, GATA6, GBA2, GBGT1, GBP1, GCFC2, GLCE,
GCNT1, GDF6, GGACT, GHDC, GIGYF2, GJC1, GLCE, GMIP, GNA13, GNAQ, GNAS,
GNG12, GNL3L, GOLGA2, GOLGA4, GOLGB1, GORASP1, GPR1, GPR183, GPR50,
GPR89A, GPRC5A, GPRC5B, GPSM2, GREM1, GRK6, GRTP1, GSE1, GTF2H2B, GTSF1,
GUCA1B, GULP1, GXYLT1, HAPLN1, HAPLN2, HAS2, HAS3, HAT1, HAUS3, HAUS6,
HAVCR2, HDAC5, HDAC7, HDX, HECTD2-AS1, HEG1, HEPH, HEY1, HLA-A, HLA-E,
HLTF, HMGA1, HMGA2, HMGB1, HMGCR, HMGN3-AS1, HMGCS1, HMGXB4,
HOOK3, HOXB3, HMOX1, HNMT, HNRNPR, HNRNPUL1, HP1BP3, HPS1, HRH1,
HSD17B12, HSPA1L, HTATIP2, HTT, IARS, IDH1, IDI1, IFT57, IGDCC4, IGF2BP2,
IGF2R, IGFBP3, IKBKAP, IL16, IL6ST, INA, INHBA, INO80, IPP4B, INPP5K, INSIG1,
INTU, INVS, IQCE, IQCG, ITCH, ITGA11, ITGA8, ITGAV, ITGB5, ITGB8, ITIH1,
ITM2C, ITPKA, ITSN1, IVD, KANSL3, KAT6B, KCNK2, KCNS1, KCNS2, KDM6A,
KDSR, KIAA1033, KIAA1143, KIAA1199, KIAA1456, KIAA1462, KIAA1522, KIAA1524,
KIAA1549, KIAA1715, KIAA1755, KIDINS220, KIF14, KIF2A, KIF21A, KIF3A, KIT,
KLC1, KLC2, KLF17, KLF6, KLHL7, KLRG1, KMT2D, KRT7, KRT18, KRT19, KRT34,
KRTAP1-1, KRTAP2-3, KRTAP2-5, L3MBTL2, LAMA2, LAMB1, LAMB2P1, LARP4,
LATS2, LDLR, LEMD3, LETM2, LGALS3, LGALS8, LGI2, LGR4, LHX9, LIMS1,
LINC00341, LINC00472, LINC00570, LINC00578, LINC00607, LINC00657, LINC00678,
LINC00702, LINC00886, LINC00961, LINC01011, LINC01118, LINC01204, LINCR-0002,
LINGO2, LMAN2L, LMNA, LMO7, LMOD1, LOC400927, LONP1, LOX, LPHN1, LRBA,
LRCH4, LRIG1, LRP4, LRP8, LRRC1, LRRC32, LRRC39, LRRC8A, LSAMP, LSS, LTBR,
LUC7L2, LUM, LYPD1, LYRM1, LZTS2, MACROD2, MAFB, MAGED4, MAGED4B,
MAMDC2, MAN1A2, MAN2A1, MAN2C1, MANEA, MAP4K4, MAPK10, MAPK13,
MARCH7, MARCH8, MASP1, MB, MB21D2, MBD1, MBOAT7, MC4R, MCM10, MDM2,
MDN1, MEAF6, MECP2, MED1, MED13L, MEDAG, MEF2D, MEGF6, MEIS2, MEMO1,
MEPCE, MFGE8, MFN2, MIAT, MICAL2, MINPP1, MIR612, MKL1, MKLN1, MKNK2,
MLLT4, MLLT10, MLST8, MMAB, MMP10, MMP24, MMS19, MMS22L, MN1,
MORF4L1, MOXD1, MPPE1, MPZL1, MRPL3, MRPL45, MRPL55, MRPS28, MRVI1,
MSANTD3, MSC, MSH2, MSH4, MSH6, MSL3, MSMO1, MSRB3, MTAP, MTERF3,
MTERFD1, MTHFD1L, MTMR3, MTMR9, MTRR, MUM1, MVD, MVK, MXRA5,
MYADM, MYB, MYCBP2, MYLK, MYO1D, MYO9B, MYOF, NA, NAA35, NAALADL2,
NADK, NAE1, NAGS, NASP, NAV1, NAV2, NCOA1, NCOA3, NCOA4, NCSTN, NDNF,
NEDD4, NELFA, NEO1, NEURL1B, NF2, NFASC, NFE2L1, NFX1, NGF, NGFR, NHLH1,

TABLE 12-continued

Table 12

NID1, NID2, NIPA1, NKX3-1, NLGN1, NLN, NOL10, NOMO3, NOTCH3, NOTUM,
NOVA2, NOX4, NPEPPS, NRD1, NREP, NRG1, NRROS, NSUN4, NT5C2, NT5E, NTNG1,
NUDT4, NUP153, NUP35, NUP50, NUPL1, NUSAP1, OCLN, ODF2, OLR1, OS9, OSBPL3,
OSBPL6, OSBPL10, OSMR, OXCT1, OXCT2, P4HA1, P4HB, PABPC1, PAIP2B, PAK4,
PAPD4, PARD3, PARN, PARP14, PARP4, PARVB, PAX6, PBLD, PBX3, PCBP2, PCCB,
PCDH10, PCDHGB3, PCGF3, PCM1, PCMTD2, PCNXL2, PCSK9, PDE1C, PDE3A,
PDE4A, PDE5A, PDE7A, PDGFD, PDGFRB, PDLIM7, PDS5B, PDXDC1, PDXDC2P,
PEAR1, PELI1, PEPD, PEX5, PFKP, PHACTR3, PHF19, PHF8, PHRF1, PHTF2, PI4K2A,
PIEZO1, PIGN, PIGU, PIK3C2B, PIK3CD, PIK3R1, PIKFYVE, PIM2, PITPNA, PITPNB,
PITPNM1, PITPNM3, PLAU, PLEC, PLEK2, PLEKHA1, PLEKHA6, PLEKHB2,
PLEKHH2, PLSCR1, PLSCR3, PLXNB2, PLXNC1, PMS1, PNISR, PODN, POLE3, POLN,
POLR1A, POLR3D, POMT2, POSTN, POU2F1, PPAPDC1A, PPARA, PPARG, PPFIBP1,
PPIP5K1, PPIP5K2, PPM1E, PPP1R12A, PPP1R26, PPP3CA, PPP6R1, PPP6R2, PRKCA,
PRKDC, PRKG1, PRMT1, PRNP, PRPF31, PRPH2, PRRG4, PRSS23, PRUNE2, PSMA4,
PSMC1, PSMD6, PSMD6-AS2, PTCH1, PTGIS, PTK2B, PTPN14, PTX3, PUF60, PUS7,
PVR, PXK, PXN, QKI, RAB2B, RAB30, RAB34, RAB38, RAB44, RAD1, RAD9B,
RAD23B, RAF1, RALB, RAP1GDS1, RAPGEF1, RARG, RARS, RARS2, RASIP1,
RASSF8, RBBP8, RBCK1, RCOR3, RBFOX2, RBKS, RBM10, RDX, RERE, RFTN1,
RFWD2, RFX3-AS1, RGCC, RGL1, RGS10, RGS3, RIF1, RNF14, RNF19A, RNF130,
RNF144A, RNF213, RNF38, RNFT1, ROR1, ROR2, RPA1, RPF2, RPL10, RPS10,
RPS6KB2, RPS6KC1, RRBP1, RWDD4, SAMD4A, SAMD9, SAMD9L, SAR1A, SART3,
SCAF4, SCAF8, SCARNA9, SCD, SCLT1, SCO1, SDCBP, SEC14L1, SEC22A, SEC24A,
SEC24B, SEC61A1, SENP6, SEPT9, SERGEF, SERPINE2, SF1, SF3B3, SGIP1, SGK3,
SGMS1, SGOL2, SGPL1, SH2B3, SH3RF1, SH3YL1, SHROOM3, SIGLEC10, SKA2,
SKIL, SKP1, SLC12A2, SLC24A3, SLC25A16, SLC25A17, SLC34A3, SLC35F3, SLC39A3,
SLC39A10, SLC4A4, SLC4A11, SLC41A1, SLC44A2, SLC46A2, SLC6A15, SLC7A6,
SLC7A8, SLC7A11, SLC9A3, SLIT3, SMARCA4, SMARCC2, SMC4, SMC6, SMCHD1,
SMG1, SMG1P3, SMOX, SMPD4, SMTN, SMYD3, SMYD5, SNAP23, SNED1, SNHG16,
SNX7, SNX14, SNX24, SNX7, SOCS2, SOCS6, SOGA2, SON, SORBS2, SORCS1,
SORCS2, SOS2, SOX7, SPATA18, SPATA20, SPATA5, SPATS2, SPDYA, SPEF2, SPG20,
SPIDR, SPINK5, SPRED2, SPRYD7, SQLE, SQRDL, SQSTM1, SRCAP, SREBF1,
SRGAP1, SRRM1, SRSF3, SSBP1, STAC2, STARD4, STAT1, STAT3, STAT4, STAU1,
STC2, STEAP2, STK32B, STRAD8, STRIP1, STRN4, STS, STX16, STXBP4, STXBP6,
SULF1, SUPT20H, SVEP1, SYNE1, SYNE2, SYNGR2, SYNPO, SYNPO2, SYNPO2L,
SYT15, SYTL2, TACC1, TAF2, TAGLN3, TANC2, TANGO6, TARBP1, TARS, TASP1,
TBC1D15, TBCA, TBL1XR1, TBL2, TCF12, TCF4, TCF7L2, TEKT4P2, TENC1, TENM2,
TEP1, TET1, TET3, TEX21P, TFCP2, TGFA, TGFB2, TGFB3, TGFBI, TGFBR1,
TGFBRAP1, TGM2, THADA, THAP4, THBS2, THRB, TIAM1, TIMP2, TJAP1, TJP2,
TLE3, TLK1, TMC3, TMEM67, TMEM102, TMEM119, TMEM134, TMEM154,
TMEM189-UBE2V1, TMEM214, TMEM256-PLSCR3, TMEM47, TMEM50B, TMEM63A,
TMX3, TNC, TNFAIP3, TNFAIP8L3, TNFRSF12A, TNFRSF14, TNIP1, TNKS1BP1,
TNPO3, TNRC18P1, TNS1, TNS3, TNXB, TOE1, TOMM40, TOMM5, TOPORS,
TP53AIP1, TP53INP1, TPRG1, TRAF3, TRAK1, TRAPPC12, TRIB1, TRIM2, TRIM23,
TRIM26, TRIM28, TRIM65, TRIM66, TRMT1L, TRPC4, TRPS1, TSC2, TSHZ1, TSHZ2,
TSPAN11, TSPAN18, TSPAN2, TSPAN7, TSSK3, TTC7A, TTC7B, TUBB2C, TUBB3,
TUBE1, TXNIP, TXNL1, TXNL4B, TXNRD1, TYW5, U2SURP, UBAP2L, UBE2D3,
UBE2G2, UBE2L3, UBE2V1, UBN2, UBQLN4, UCHL5, UHMK1, UHRF1BP1L, UNC13B,
UNC5B, URGCP, URGCP-MRPS24, USP19, USP7, USP27X, UVRAG, VANGL1, VARS2,
VAV2, VCL, VDAC2, VIM-AS1, VIPAS39, VPS13A, VPS29, VPS41, VPS51, VSTM2L,
VWA8, VWF, WDR19, WDR27, WDR37, WDR48, WDR90, WDR91, WHSC2, WIPF1,
WISP1, WNK1, WNT5B, WNT10B, WSB1, WWTR1, XDH, XIAP, XRN2, YAP1, YDJC,
YES1, YPEL5, YTHDF3, Z24749, ZAK, ZBTB10, ZBTB24, ZBTB26, ZBTB7A, ZC3H12C,
ZC3H14, ZC3H18, ZCCHC5, ZCCHC8, ZCCHC11, ZEB1, ZEB2, ZFAND1, ZFAND5,
ZFP82, ZHX3, ZMIZ1, ZMIZ1-AS1, ZMIZ2, ZMYM2, ZNF12, ZNF138, ZNF148, ZNF208,
ZNF212, ZNF219, ZNF227, ZNF232, ZNF24, ZNF268, ZNF28, ZNF280D, ZNF281,
ZNF335, ZNF350, ZNF37A, ZNF37BP, ZNF395, ZNF426, ZNF431, ZNF583, ZNF618,
ZNF621, ZNF652, ZNF655, ZNF660, ZNF674, ZNF680, ZNF730, ZNF74, ZNF764,
ZNF777, ZNF778, ZNF780A, ZNF7804A, ZNF79, ZNF827, ZNF836, ZNF837, ZNF839,
ZNF91 and ZSCAN25

Methods of Preventing and/or Treating Diseases

In another aspect, provided herein are methods for modifying RNA splicing in order to prevent and/or treat a disease associated with the aberrant expression of a product of a gene (e.g., an mRNA transcript or protein), wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In a specific aspect, the precursor RNA transcript comprises in 5' to 3' order: a 5' splice site, a branch point, a 3' splice site and an intronic REMS. In another specific aspect, the precursor RNA transcript comprises in 5' to 3' order: a branch point, a 3' splice site and an intronic REMS. In another specific aspect, the precursor RNA transcript contains in 5' to 3' order: a first 5' splice site, a first branch point, a first 3' splice site, an intronic REMS, a second branch point, and a second 3' splice site. In another specific aspect the precursor RNA transcript contains in 5' to 3' order: an intronic REMS, a branch point, and a 3' splice site.

In certain aspects, the gene is any one of the genes described herein. In certain aspects, the gene contains a nucleotide sequence encoding a non-endogenous intronic REMS. In one aspect, provided herein are methods for modifying RNA splicing in order to prevent and/or treat a disease associated with aberrant expression of a product of a gene (e.g., an mRNA, RNA transcript or protein) described herein, the methods comprising administering to a human or non-human subject a compound of Formula (I) or a form thereof, or a pharmaceutical composition comprising a compound of Formula (I) or a form thereof and a pharmaceutically acceptable carrier, excipient or diluent.

In another aspect, provided herein are methods for modifying RNA splicing in order to prevent and/or treat a disease associated with aberrant expression of a product of a gene described herein (e.g., an mRNA, RNA transcript or protein), wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In a specific aspect, the precursor RNA transcript comprises in 5' to 3' order: a branch point, a 3' splice site and an intronic REMS. In another specific aspect, the precursor RNA transcript contains in 5' to 3' order: a first 5' splice site, a first branch point, a first 3' splice site, an intronic REMS, a second branch point, and a second 3' splice site. In another specific aspect the precursor RNA transcript contains in 5' to 3' order: an intronic REMS, a branch point, and a 3' splice site.

In another aspect, provided herein are methods for modifying RNA splicing in order to prevent and/or treat a disease associated with aberrant expression of a product of a gene (e.g., an mRNA, RNA transcript or protein) described herein, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In a specific aspect, the precursor RNA transcript comprises in 5' to 3' order: a 5' splice site, a branch point, a 3' splice site and an intronic REMS. In another specific aspect, the precursor RNA transcript comprises in 5' to 3' order: a branch point, a 3' splice site and an intronic REMS. In another specific aspect, the precursor RNA transcript contains in 5' to 3' order: a first 5' splice site, a first branch point, a first 3' splice site, an intronic REMS, a second branch point, and a second 3' splice site. In another specific aspect the precursor RNA transcript contains in 5' to 3' order: an intronic REMS, a branch point, and a 3' splice site.

In another aspect, provided herein are methods for modifying RNA splicing in order to prevent and/or treat a disease associated with aberrant expression of a product of a gene described herein (e.g., an mRNA, RNA transcript or protein), comprising administering to a human or non-human subject a compound of Formula (I) or a form thereof, or a pharmaceutical composition comprising a compound of Formula (I) or a form thereof and a pharmaceutically acceptable carrier, excipient or diluent. See the example section for additional information regarding the genes described herein.

In another aspect, provided herein are methods for modifying RNA splicing in order to prevent and/or treat a disease in which a change in the level of expression of one, two, three or more RNA isoforms encoded by a gene is beneficial to the prevention and/or treatment of the disease, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In a specific aspect, the precursor RNA transcript comprises in 5' to 3' order: a 5' splice site, a branch point, a 3' splice site and an intronic REMS. In another specific aspect, the precursor RNA transcript comprises in 5' to 3' order: a branch point, a 3' splice site and an intronic REMS. In another specific aspect, the precursor RNA transcript contains in 5' to 3' order: a first 5' splice site, a first branch point, a first 3' splice site, an intronic REMS, a second branch point, and a second 3' splice site. In another specific aspect the precursor RNA transcript contains in 5' to 3' order: an intronic REMS, a branch point, and a 3' splice site.

In certain aspects, the gene is any one of the genes described herein. In certain aspects, the gene contains a nucleotide sequence encoding the non-endogenous intronic REMS. In one aspect, provided herein are methods for modifying RNA splicing in order to prevent and/or treat a disease in which the modulation (e.g., increase or decrease) in the expression one, two, three or more RNA isoforms encoded by a gene described herein is beneficial to the prevention and/or treatment of the disease, the methods comprising administering to a human or non-human subject a compound of Formula (I) or a form thereof, or a pharmaceutical composition comprising a compound of Formula (I) or a form thereof and a pharmaceutically acceptable carrier, excipient or diluent.

In another aspect, provided herein are methods for modifying RNA splicing in order to prevent and/or treat a disease in which the modulation (e.g., increase or decrease) in the expression one, two, three or more RNA isoforms encoded by a gene described herein is beneficial to the prevention and/or treatment of the disease, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In a specific aspect, the precursor RNA transcript comprises in 5' to 3' order: a 5' splice site, a branch point, a 3' splice site and an intronic REMS. In another specific aspect, the precursor RNA transcript comprises in 5' to 3' order: a branch point, a 3' splice site and an intronic REMS. In another specific aspect, the precursor RNA transcript contains in 5' to 3' order: a first 5' splice site, a first branch point, a first 3' splice site, an intronic REMS, a second branch point, and a second 3' splice site. In another specific aspect the precursor RNA transcript contains in 5' to 3' order: an intronic REMS, a branch point, and a 3' splice site.

In another aspect, provided herein are methods for modifying RNA splicing in order to prevent and/or treat a disease in which the modulation (e.g., increase or decrease) in the expression one, two, three or more RNA isoforms encoded by a gene described herein is beneficial to the prevention and/or treatment of the disease, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In a specific aspect, the precursor RNA transcript comprises in 5' to 3' order: a 5' splice site, a branch point, a 3' splice site and an intronic REMS. In another specific aspect, the precursor RNA transcript comprises in 5' to 3' order: a branch point, a 3' splice site and an intronic REMS. In another specific aspect, the precursor RNA transcript contains in 5' to 3' order: a first 5' splice site, a first branch point, a first 3' splice site, an intronic REMS, a second branch point, and a second 3' splice site. In another specific aspect the precursor RNA transcript contains in 5' to 3' order: an intronic REMS, a branch point, and a 3' splice site.

In another aspect, provided herein are methods for modifying RNA splicing in order to prevent and/or treat a disease in which the modulation (e.g., increase or decrease) in the expression one, two, three or more RNA isoforms encoded by a gene described herein is beneficial to the prevention and/or treatment of the disease, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In a specific aspect, one, two, three or more RNA isoforms encoded by a gene described herein are decreased following administration of a compound of Formula (I) or a form thereof and a pharmaceutically acceptable carrier, excipient or diluent. See the example section for additional information regarding the genes described herein.

In another aspect, provided herein are methods for modifying RNA splicing in order to prevent and/or treat a disease in which a change in the level of expression of one, two, three or more protein isoforms encoded by a gene is beneficial to the prevention and/or treatment of the disease, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In a specific aspect, the precursor RNA transcript comprises in 5' to 3' order: a 5' splice site, a branch point, a 3' splice site and an intronic REMS. In another specific aspect, the precursor RNA transcript comprises in 5' to 3' order: a branch point, a 3' splice site and an intronic REMS. In another specific aspect, the precursor RNA transcript comprises in 5' to 3' order: a first 5' splice site, a first branch point, a first 3' splice site, an intronic REMS, a second branch point, and a second 3' splice site. In another specific aspect the precursor RNA transcript comprises in 5' to 3' order: an intronic REMS, a branch point, and a 3' splice site.

In certain aspects, the gene is any one of the genes described herein. In certain aspects, the gene contains a nucleotide sequence encoding a non-endogenous intronic REMS. In one aspect, provided herein are methods for modifying RNA splicing in order to prevent and/or treat a disease in which the modulation (e.g., increase or decrease) in the expression one, two, three or more protein isoforms encoded by a gene described herein is beneficial to the prevention and/or treatment of the disease, the methods comprising administering to a human or non-human subject a compound of Formula (I) or a form thereof, or a pharmaceutical composition comprising a compound of Formula (I) or a form thereof and a pharmaceutically acceptable carrier, excipient or diluent.

In another aspect, provided herein are methods for modifying RNA splicing in order to prevent and/or treat a disease in which the modulation (e.g., increase or decrease) in the expression one, two, three or more protein isoforms encoded by a gene described herein is beneficial to the prevention and/or treatment of the disease, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In a specific aspect, the precursor RNA transcript comprises in 5' to 3' order: a 5' splice site, a branch point, a 3' splice site and an intronic REMS. In another specific aspect, the precursor RNA transcript comprises in 5' to 3' order: a branch point, a 3' splice site and an intronic REMS. In another specific aspect, the precursor RNA transcript comprises in 5' to 3' order: a first 5' splice site, a first branch point, a first 3' splice site, an intronic REMS, a second branch point, and a second 3' splice site. In another specific aspect the precursor RNA transcript comprises in 5' to 3' order: an intronic REMS, a branch point, and a 3' splice site.

In another aspect, provided herein are methods for modifying RNA splicing in order to prevent and/or treat a disease in which the modulation (e.g., increase or decrease) in the expression one, two, three or more protein isoforms encoded by a gene described herein is beneficial to the prevention and/or treatment of the disease, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In a specific aspect, one, two, three or more RNA isoforms encoded by a gene described herein are decreased following administration of a compound of Formula (I) or a form thereof and a pharmaceutically acceptable carrier, excipient or diluent. See the example section for additional information regarding the genes described herein.

In another aspect, provided herein is a method for modifying RNA splicing in order to prevent, treat or prevent and treat a disease in a subject in which the modulation (e.g., increase or decrease) in the expression one, two, three or more protein isoforms encoded by a gene is beneficial to the prevention and/or treatment of the disease, wherein the gene comprises a DNA nucleotide sequence encoding two exons and an intron, wherein the nucleotide sequence encoding a first exon is upstream of the nucleotide sequence encoding the intron and the nucleotide sequence encoding a second exon is downstream of the nucleotide sequence encoding the intron, wherein the DNA nucleotide sequence encoding the intron comprises in 5' to 3' order: a nucleotide sequence encoding a first 5' splice site, a nucleotide sequence encoding a first branch point, a nucleotide sequence encoding a first 3' splice site, a nucleotide sequence encoding an iREMS, a nucleotide sequence encoding a second branch point and a nucleotide sequence encoding a second 3' splice site, wherein the nucleotide sequence encoding the iREMS comprises a DNA sequence GAgtrngn, and wherein r is adenine or guanine and n is any nucleotide, the method comprising administering a compound described herein (for example, a compound of Formula (I) or a form thereof) to the subject.

In another aspect, provided herein is a method for modifying RNA splicing in order to prevent, treat or prevent and treat a disease in a subject in which the modulation (e.g., increase or decrease) in the expression one, two, three or more protein isoforms encoded by a gene is beneficial to the prevention and/or treatment of the disease, wherein the gene comprises a DNA nucleotide sequence encoding two exons and an intron, wherein the nucleotide sequence encoding a first exon is upstream of the nucleotide sequence encoding the intron and the nucleotide sequence encoding a second exon is downstream of the nucleotide sequence encoding the intron, wherein the DNA nucleotide sequence of the intron comprises in 5' to 3' order: a nucleotide sequence encoding an iREMS, a nucleotide sequence encoding a branch point and a nucleotide sequence encoding a 3' splice site, wherein the nucleotide sequence encoding the iREMS comprises a DNA sequence GAgtrngn, and wherein r is adenine or guanine and n is any nucleotide, the method comprising administering a compound described herein (for example, a compound of Formula (I) or a form thereof) to the subject.

In another aspect, provided herein is a method for modifying RNA splicing in order to prevent, treat or prevent and treat a disease in a subject in which the modulation (e.g., increase or decrease) in the expression one, two, three or more protein isoforms encoded by a gene is beneficial to the prevention and/or treatment of the disease, wherein the gene comprises a DNA nucleotide sequence encoding two exons and an intron, and wherein the DNA nucleotide sequence encodes exonic and intronic elements illustrated in FIG. 1A, the method comprising administering a compound described herein (for example, a compound of Formula (I) or a form thereof) to the subject.

In another aspect, provided herein is a method for modifying RNA splicing in order to prevent, treat or prevent and treat a disease in a subject in which the modulation (e.g., increase or decrease) in the expression one, two, three or more protein isoforms encoded by a gene is beneficial to the prevention and/or treatment of the disease, wherein the gene comprises a DNA nucleotide sequence encoding two exons and an intron, and wherein the DNA nucleotide sequence encodes exonic and intronic elements illustrated in FIG. 1B, the method comprising administering a compound described herein (for example, a compound of Formula (I) or a form thereof) to the subject.

In another aspect, provided herein is a method for modifying RNA splicing in order to prevent, treat or prevent and treat a disease in a subject in which the modulation (e.g., increase or decrease) in the expression one, two, three or more protein isoforms encoded by a gene is beneficial to the prevention and/or treatment of the disease, wherein the gene comprises a DNA nucleotide sequence encoding two exons and an intron and wherein the DNA nucleotide sequence encodes exonic and intronic elements illustrated in FIG. 1C, the method comprising administering a compound described herein (for example, a compound of Formula (I) or a form thereof) to the subject.

In a specific aspect, the gene is a gene described in a table in this disclosure.

In some aspects, the compound of Formula (I) or a form thereof that is administered to a subject is a compound described herein.

In a specific aspect, the methods for modifying RNA splicing in order to prevent a disease described herein prevent the onset or development of one or symptoms of the disease. In another aspect, the methods for preventing a disease described herein prevent the recurrence of the disease or delays the recurrence of the disease. In another aspect, the methods for treating a disease described herein has one, two or more of the effects: (i) reduce or ameliorate the severity of the disease; (ii) inhibit the progression of the disease; (iii) reduce hospitalization of a subject; (iv) reduce hospitalization length for a subject: (v) increase the survival of a subject; (vi) improve the quality of life of a subject; (vii) reduce the number of symptoms associated with the disease; (viii) reduce or ameliorates the severity of a symptom(s) associated with the disease; (ix) reduce the duration of a symptom(s) associated with the disease; (x) prevent the recurrence of a symptom associated with the disease; (xi) inhibit the development or onset of a symptom of the disease; and/or (xii) inhibit of the progression of a symptom associated with the disease.

Artificial Gene Constructs

Also provided herein are artificial gene constructs comprising a DNA sequence encoding exons and one or more introns, wherein the nucleotide sequence encoding at least one intron comprises in 5' to 3' order: a nucleotide sequence encoding a branch point, a nucleotide sequence encoding a 3' splice site and a nucleotide sequence encoding an intronic REMS, and artificial gene constructs comprising an RNA sequence that comprises exons and one or more introns, wherein at least one intron comprises in 5' to 3' order: a branch point, a 3' splice site and an intronic REMS. The DNA sequence described herein can be or derived from, for example, a genomic DNA sequence or a DNA analog thereof. The RNA sequence described herein can be or derived from, for example, a precursor RNA transcript or an RNA analog thereof. As used herein, the term "artificial gene construct" refers to a DNA or RNA gene construct that comprises a nucleotide sequence not found in nature.

In another aspect, provided herein is an artificial gene construct comprising an RNA sequence comprising two exons and an intron, wherein a first exon is upstream of the intron and a second exon is downstream of the intron, wherein the RNA nucleotide sequence of the intron comprises in 5' to 3' order: a first 5' splice site, a first branch point, a first 3' splice site, an iREMS, a second branch point and a second 3' splice site, wherein the iREMS comprises an RNA sequence GAgurngn, and wherein r is adenine or guanine and n is any nucleotide.

In another aspect, provide herein is an artificial gene construct comprising an RNA sequence comprising two exons and an intron, wherein a first exon is upstream of the intron and a second exon is downstream of the intron, wherein the RNA nucleotide sequence of the intron comprises in 5' to 3' order: an iREMS, a branch point and a 3' splice site, wherein the iREMS comprises an RNA sequence GAgurngn, and wherein r is adenine or guanine and n is any nucleotide.

In another aspect, provided herein is an artificial gene construct comprising an RNA sequence comprising two exons and an intron, wherein the RNA sequence comprises exonic and intronic elements illustrated in FIG. 1A.

In another aspect, provided herein is an artificial gene construct comprising an RNA sequence comprising two exons and an intron, wherein the RNA sequence comprises exonic and intronic elements illustrated in FIG. 1B.

In another aspect, provided herein is an artificial gene construct comprising an RNA sequence comprising two exons and an intron, wherein the RNA sequence comprises exonic and intronic elements illustrated in FIG. 1C.

In another aspect, provided herein is an artificial gene construct comprising a DNA sequence encoding two exons and an intron, wherein the nucleotide sequence encoding a first exon is upstream of the nucleotide sequence encoding the intron and the nucleotide sequence encoding a second exon is downstream of the nucleotide sequence encoding the intron, wherein the nucleotide sequence encoding the intron comprises in 5' to 3' order: a nucleotide sequence encoding a first 5' splice site, a nucleotide sequence encoding a first branch point, a nucleotide sequence encoding a first 3' splice site, an iREMS, a nucleotide sequence encoding a second branch point and a nucleotide sequence encoding a second 3' splice site, wherein the nucleotide sequence encoding the iREMS comprises a DNA sequence GAgtrngn, and wherein r is adenine or guanine and n is any nucleotide.

In another aspect, provide herein is an artificial gene construct comprising a DNA sequence encoding two exons and an intron, wherein the nucleotide sequence encoding a first exon is upstream of the nucleotide sequence encoding the intron and the nucleotide sequence encoding a second exon is downstream of the nucleotide sequence encoding the intron, wherein the nucleotide sequence encoding the intron comprises in 5' to 3' order: a nucleotide sequence encoding an iREMS, a nucleotide sequence encoding a branch point and a nucleotide sequence encoding a 3' splice site, wherein the nucleotide sequence encoding the iREMS comprises an DNA sequence GAgtrngn, wherein r is adenine or guanine and n is any nucleotide.

In another aspect, provide herein is an artificial gene construct comprising a DNA sequence encoding two exons and an intron, wherein the DNA sequence encodes exonic and intronic elements illustrated in FIG. 1A.

In another aspect, provide herein is an artificial gene construct comprising a DNA sequence encoding two exons and an intron, wherein the DNA sequence encodes exonic and intronic elements illustrated in FIG. 1B.

In another aspect, provide herein is an artificial gene construct comprising a DNA sequence encoding two exons and an intron, wherein the DNA sequence encodes exonic and intronic elements illustrated in FIG. 1C.

In one aspect, provided herein are artificial gene constructs comprising an intronic REMS. In one aspect, an artificial gene construct comprises genomic DNA or DNA encoding exons and one, two or more introns, wherein a nucleotide sequence encoding an intronic REMS, which may be upstream or downstream of a nucleotide sequence encoding a branch point and a nucleotide sequence encoding a 3' splice site, is introduced into the nucleotide sequence encoding an intron by genetic engineering. In another aspect, an artificial gene construct comprises DNA encoding exons and one, two or more introns, wherein the nucleotide sequence encoding an intron comprises a nucleotide sequence encoding an intronic REMS, a nucleotide sequence encoding a 3' splice site(s) and a nucleotide sequence encoding a branch point(s) sequence, wherein the nucleotide sequence encoding an intronic REMS, which may be upstream or downstream of at least one nucleotide sequence encoding a branch point and at least one nucleotide sequence encoding a 3' splice site, is introduced into the nucleotide sequence encoding the intron by genetic engineering. In another aspect, an artificial gene construct comprises DNA encoding exons and one, two or more introns, wherein the nucleotide sequence encoding an intron comprises a nucleotide sequence encoding a 3' splice site(s) and a nucleotide sequence encoding a branch point(s), wherein a nucleotide sequence encoding an intron is modified to introduce a nucleotide sequence encoding an intronic REMS. In some aspects, an artificial gene construct comprises a DNA sequence that is modified to introduce a nucleotide sequence encoding an intronic REMS, wherein the location of the intronic REMS is as illustrated in any of FIGS. 1A-1C. In certain aspects, the DNA sequence chosen to be used in the production of an artificial gene construct may contain a nucleotide sequence encoding an intronic REMS and an additional nucleotide sequence encoding an intronic REMS or a branch point or a 3' splice site sequences are introduced. In specific aspects, the nucleotide sequence encoding an intronic REMS or a branch point or a 3' splice site sequence is a nucleotide sequence encoding a non-endogenous intronic REMS or branch point or 3' splice site sequence, i.e., a sequence not naturally found in the DNA sequence of the artificial gene construct. In certain aspects, the artificial gene construct comprises other elements, such as a promoter (e.g., a constitutive, inducible or tissue specific promoter), a Poly(A) site, a transcription termination site, and a transcription binding site(s). In certain aspects, the artificial gene construct comprises at least the sequences to encode a therapeutic protein. In some aspects, the artificial gene construct comprises at least an intronic REMS for a gene described herein. In certain aspects, the artificial gene construct comprises at least the exons of a detectable reporter gene, such as green fluorescent protein (GFP), yellow fluorescent protein (YFP), red fluorescent protein, beta galactosidase, renilla luciferase, firefly luciferase, etc.

In certain aspects, an artificial gene construct is produced as follows: a nucleotide sequence encoding an intronic REMS is introduced into a nucleotide sequence encoding an existing intronic branch point and intronic 3' splice site of genomic DNA or DNA, wherein the DNA encodes two or more exons and one or more introns, and wherein the nucleotide sequence encoding the intronic REMS is upstream of a nucleotide sequence encoding a branch point and a 3' splice site. In some aspects, an artificial gene construct is produced as follows: a nucleotide sequence encoding an intronic REMS is introduced upstream of a nucleotide sequence encoding a branch point and a 3' splice site of genomic DNA or DNA, wherein the DNA encodes two or more exons and an intron(s). In a specific aspect, the nucleotide sequence encoding the intronic REMS is introduced internally within a nucleotide sequence encoding an intron. In certain aspects, an artificial gene construct is produced as follows: a nucleotide sequence encoding an intronic REMS, a nucleotide sequence encoding a branch point, and a nucleotide sequence encoding a 3' splice site are introduced into a cDNA, wherein the nucleotide sequence encoding the intronic REMS may be upstream of the branch point and 3' splice site, respectively; or may be downstream of the 3' splice site and branch point, respectively. The nucleotide sequence encoding the intronic REMS functions as a 5' splice site. In certain aspects, the nucleotide sequence encoding the intronic REMS is internally within an intron. In a specific aspect, the genomic DNA or DNA chosen for use in the production of an artificial gene construct does not contain one or more of a nucleotide sequence encoding an intronic REMS or a nucleotide sequence encoding a branch point or a nucleotide sequence encoding a 3' splice site. In certain aspects, the genomic DNA or DNA chosen for use in the production of an artificial gene construct contains an intronic REMS and an additional intronic REMS is introduced. In some aspects, care should be taken to introduce a nucleotide sequence encoding an intronic REMS into a DNA sequence so as not to disrupt an open reading frame or introduce a stop codon. The introduction of a nucleotide sequence encoding an intronic REMS into a DNA sequence may or may not result in an amino acid change at the protein level. In certain aspects, the introduction of a nucleotide sequence encoding an intronic REMS into a DNA sequence results in an amino acid change at the protein level. In some aspects, this amino acid change is a conservative amino acid substitution. In other aspects, the introduction of a nucleotide sequence encoding an intronic REMS into a DNA sequence does not result in an amino acid change at the protein level. Techniques known to one of skill in the art may be used to introduce an intronic REMS and other elements, such as a branch point sequence or 3' splice site sequence into a DNA sequence, e.g., gene editing techniques such as the CRISPR-Cas approach, Transcription Activator-Like Effector Nucleases (TALENs), or Zinc finger nucleases (ZFNs) may be used.

In certain aspects, an artificial gene construct comprises an RNA sequence comprising exons and one, two or more introns, wherein an intronic REMS 5' splice site, which is downstream of a 3' splice site, is introduced into an intron by genetic engineering. In another aspect, an artificial gene construct comprises an RNA sequence comprising exons and one, two, or more introns, wherein an intron comprises a 5' splice site(s), a 3' splice site(s) and a branch point(s), wherein an intronic REMS, which is upstream of a 3' splice site, is introduced into an intron by genetic engineering. In another aspect, an artificial gene construct comprises an RNA sequence comprising exons and one, two, or more introns, wherein an intron comprises a 3' splice site(s) and a branch point(s), wherein an intron is modified to introduce an intronic REMS. In specific aspects, the intronic REMS is non-endogenous, i.e., not naturally found in the RNA sequence of the artificial gene construct. In certain aspects, the artificial gene construct comprises other elements, such as a promoter (e.g., a tissue-specific promoter or constitutively expressed promoter), 5' untranslated region, 3' untranslated region, a binding site(s) for RNA binding protein(s) that regulate splice site (5' and 3') recognition and catalysis, a small molecule RNA sensor(s), e.g., riboswitches, stem-loop structures, and/or internal ribosome entry sites (IRES) and the like. In certain aspects, the artificial gene construct comprises at least the introns of a gene encoding a therapeutic protein. In some aspects, the artificial gene construct comprises at least the introns of a gene described herein. In a specific aspect, the RNA transcript chosen to be used in the production of an artificial gene construct does not contain an intronic REMS. In certain aspects, the RNA transcript chosen to use in the production of an artificial gene construct contains an intronic REMS and an additional exonic or intronic REMS is introduced. In other aspects, the artificial gene construct comprises at least one intron and two exons of a detectable reporter gene, such as green fluorescent protein (GFP), yellow fluorescent protein (YFP), red fluorescent protein, beta galactosidase, renilla luciferase, firefly luciferase, etc.

In certain aspects, an artificial gene construct is produced as follows: an intronic REMS is introduced into an existing 5' splice site of precursor RNA, wherein the RNA comprises two or more exons and one or more introns, and wherein an intronic REMS is upstream of a branch point sequence and a 3' splice site sequence. In some aspects, an artificial gene construct is produced as follows: an intronic REMS is introduced upstream of a 3' splice site of a precursor RNA, wherein the RNA comprises two or more exons and an intron(s). In a specific aspect, the intronic REMS is introduced internally within an intron. In certain aspects, an artificial gene construct is produced as follows: a branch point, a 3' splice site and an intronic REMS are introduced into an mRNA, wherein the REMS may be either downstream or upstream of the branch point and 3' splice site. The intronic REMS functions as a 5' splice site. In certain aspects, the intronic REMS is located in an intron. In some aspects, care should be taken to introduce an intronic REMS into an RNA sequence so as not to disrupt an open reading frame or introduce a stop codon. The introduction of an intronic REMS into an RNA transcript may or may not result in an amino acid change at the protein level. In certain aspects, the introduction of an intronic REMS into an RNA transcript results in an amino acid change at the protein level. In some aspects, this amino acid change is a conservative amino acid substitution. In other aspects, the introduction of an intronic REMS into an RNA transcript does not result in an amino acid change at the protein level. Techniques known to one of skill in the art may be used to introduce an intronic REMS and other elements, such as a branch point or 3' splice site into an RNA transcript.

In some aspects, an artificial gene construct is present in a viral vector (e.g., an adeno-associated virus (AAV), self-complimentary adeno-associated virus (scAAV), adenovirus, retrovirus, lentivirus (e.g., Simian immunodeficiency virus, human immunodeficiency virus, or modified human immunodeficiency virus), Newcastle disease virus (NDV), herpes virus (e.g., herpes simplex virus), alphavirus, vaccina virus, etc.), a plasmid, or other vector (e.g., non-viral vectors, such as lipoplexes, liposomes, polymerosomes, or nanoparticles).

In some aspects, the artificial gene construct is an RNA molecule modified to enable cellular uptake. In certain aspects, the artificial gene construct is an RNA molecule containing pseudouridine or other modified/artificial nucleotides for enhanced cellular uptake and gene expression.

The use of an artificial gene construct described herein in gene therapy allows one to regulate the amount and type of a protein produced from the construct depending on the presence of a compound described herein. The compound is essentially a tunable switch that, depending on the amount and duration of the dose of the compound, regulates the amount and type of protein produced.

In certain aspects, an RNA transcript transcribed from an artificial gene construct that is DNA would not produce or produce substantially less functional protein in the presence of a compound described herein than the amount of functional protein produced in the absence of a compound described herein. For example, if the artificial gene construct comprises a nucleotide sequence encoding an intronic REMS, which is downstream of an intronic nucleotide sequence encoding a 3' splice site, then the creation of an intronic exon would ultimately result in less amount of the original protein (i.e., protein produced when RNA splicing is not modified) being produced in the presence of a compound described herein. Alternatively, in certain aspects, an RNA transcript transcribed from an artificial gene construct that is DNA would produce or would produce substantially less functional protein in the presence of a compound described herein than the amount of functional protein produced in the absence of a compound described herein.

In certain aspects, an artificial gene construct or vector comprising an artificial gene construct is used in cell culture. For example, in a cell(s) transfected with an artificial gene construct or transduced with a vector comprising an artificial gene construct, the amount and type of a protein produced from the artificial gene construct can be modulated or modified depending upon whether or not a compound described herein is contacted with the transfected cell(s). For example, if the artificial gene construct comprises a nucleotide sequence encoding an intronic REMS, which is downstream of a nucleotide sequence encoding a 3' splice site, then the likelihood of producing an intronic exon would be less in the absence of the compound relative to in the presence of the compound. Thus, the use of an artificial gene construct described herein allows one to regulate the amount and type of a protein produced from the construct depending on whether or not a compound described herein is present. In other words, a compound described herein is essentially a switch that regulates the amount and type of protein produced. This regulation of the production of protein could be useful, e.g., when trying to assess the role of certain genes or the effects of certain agents on pathways. The amount of the protein produced can be modified based on the amount of a compound described herein that is contacted with the transfected cell and/or how long the compound is contacted with the transfected cell.

In certain aspects, an animal (e.g., a non-human animal, such as a mouse, rat, fly, etc.) is engineered to contain an artificial gene construct or a vector comprising an artificial gene construct. Techniques known to one of skill in the art may be used to engineer such animals. The amount of protein produced by this engineered animal can be regulated by whether or not a compound described herein is administered to the animal. The amount of the protein produced can be titrated based on the dose and/or the duration of administration of a compound described herein to the engineered animal. In certain aspects, the artificial gene construct encodes a detectable reporter gene, such as green fluorescent protein (GFP), yellow fluorescent protein (YFP), red fluorescent protein, beta galactosidase, renilla luciferase, firefly luciferase, etc. In accordance with this aspect, the engineered animal may be used to monitor development at different stages, visualize tissue function, etc. In other aspects, the artificial gene construct encodes a therapeutic gene product, such as described herein. In accordance with this aspect, the engineered animal may be used to monitor development at different stages or in functional biological studies where a certain protein or protein isoform needs to be expressed only for a period of time and not constitutively, etc.

In certain aspects, an artificial gene construct or a vector comprising an artificial gene construct are used in gene therapy. Non-limiting examples of vectors include, but are not limited to, plasmids and viral vectors, such as vectors derived from replication defective retroviruses, adenoviruses, adeno-associated viruses and baculoviruses. The vector can be an RNA vector or preferably a DNA vector.

Gene Therapy

In another aspect, artificial gene constructs or vectors comprising an artificial gene construct may be provided for use in gene therapy. The use of an artificial gene construct described herein in gene therapy allows one to regulate the amount and type of a protein produced from the construct depending on whether or not a compound described herein is present. The compound is essentially a switch that regulates the amount and type of protein produced.

In certain aspects provided herein, an RNA transcript transcribed from an artificial gene construct that is DNA would produce substantially more functional protein in the presence of a compound described herein than the amount of functional protein produced in the absence of a compound described herein. For example, an artificial gene construct or vector that comprises a nucleotide sequence encoding an intronic REMS, which is downstream of a nucleotide sequence encoding a branch point and a 3' splice site, has a lower likelihood of producing an intronic exon in the absence of a compound described herein. If the protein produced as a result of iExon inclusion is a functional protein, then the result of compound administration would ultimately result in more of the functional protein being produced from the artificial gene construct. Thus, an artificial gene construct or a vector comprising an artificial gene construct may be useful in treating and/or preventing certain conditions or diseases associated with genes when the construct or vector increases the likelihood of producing an intronic exon in the presence of a compound described herein. The conditions or diseases may include those described herein.

Alternatively, in certain aspects, an RNA transcript transcribed from an artificial gene construct that is DNA would produce substantially less functional protein in the presence of a compound described herein than the amount of functional protein produced in the absence of a compound described herein. For example, an artificial gene construct or vector that comprises a nucleotide sequence encoding an intronic REMS, has a higher likelihood of producing an intronic exon in the presence of a compound described herein. If the protein produced as a result of iExon inclusion is not a functional protein, but the protein produced without iExon inclusion is a functional protein, then the result of compound administration would result in reduction in the production of a functional protein. However, in the absence of a compound described herein, normal splicing would occur, and the production of the functional protein would not be reduced. The amount and type of the protein produced can be titrated based on dose and duration of dosing of the compound. In a specific aspect, the artificial gene construct used in gene therapy comprises an RNA sequence comprising two exons and an intron, wherein a first exon is upstream of the intron and a second exon is downstream of the intron, wherein the RNA nucleotide sequence of the intron comprises in 5' to 3' order: a first 5' splice site, a first branch point, a first 3' splice site, an iREMS, a second branch point and a second 3' splice site, wherein the iREMS comprises an RNA sequence GAgurngn, and wherein r is adenine or guanine and n is any nucleotide.

In another specific aspect, the artificial gene construct used in gene therapy comprises an RNA sequence comprising two exons and an intron, wherein a first exon is upstream of the intron and a second exon is downstream of the intron, wherein the RNA nucleotide sequence of the intron comprises in 5' to 3' order: an iREMS, a branch point and a 3' splice site, wherein the iREMS comprises an RNA sequence GAgurngn, and wherein r is adenine or guanine and n is any nucleotide.

In another specific aspect, the artificial gene construct used in gene therapy comprises an RNA sequence comprising two exons and an intron, wherein the RNA sequence comprises exonic and intronic elements illustrated in FIG. 1A.

In another specific aspect, the artificial gene construct used in gene therapy comprises an RNA sequence comprising two exons and an intron, wherein the RNA sequence comprises exonic and intronic elements illustrated in FIG. 1B.

In another specific aspect, the artificial gene construct used in gene therapy comprises an RNA sequence comprising two exons and an intron, wherein the RNA sequence comprises exonic and intronic elements illustrated in FIG. 1C.

In another specific aspect, the artificial gene construct used in gene therapy comprises a DNA sequence encoding two exons and an intron, wherein the nucleotide sequence encoding a first exon is upstream of the nucleotide sequence encoding the intron and the nucleotide sequence encoding a second exon is downstream of the nucleotide sequence encoding the intron, wherein the nucleotide sequence encoding the intron comprises in 5' to 3' order: a nucleotide sequence encoding a first 5' splice site, a nucleotide sequence encoding a first branch point, a nucleotide sequence encoding a first 3' splice site, a nucleotide sequence encoding an iREMS, a nucleotide sequence encoding a second branch point and a nucleotide sequence encoding a second 3' splice site, wherein the nucleotide sequence encoding the iREMS comprises a DNA sequence GAgtrngn, wherein r is adenine or guanine and n is any nucleotide.

In another specific aspect, the artificial gene construct used in gene therapy comprises a DNA sequence encoding two exons and an intron, wherein the nucleotide sequence encoding a first exon is upstream of the nucleotide sequence encoding the intron and the nucleotide sequence encoding a second exon is downstream of the nucleotide sequence encoding the intron, wherein the nucleotide sequence encoding the intron comprises in 5' to 3' order: a nucleotide sequence encoding an iREMS, a nucleotide sequence encoding a branch point and a nucleotide sequence encoding a 3' splice site, wherein the nucleotide sequence encoding the iREMS comprises an DNA sequence GAgtrngn, wherein r is adenine or guanine and n is any nucleotide.

In another specific aspect, the artificial gene construct used in gene therapy comprises a DNA sequence encoding two exons and an intron, wherein the DNA sequence encodes exonic and intronic elements illustrated in FIG. 1A.

In another specific aspect, the artificial gene construct used in gene therapy comprises a DNA sequence encoding two exons and an intron, wherein the DNA sequence encodes exonic and intronic elements illustrated in FIG. 1B.

In another specific aspect, the artificial gene construct used in gene therapy comprises a DNA sequence encoding two exons and an intron, wherein the DNA sequence encodes exonic and intronic elements illustrated in FIG. 1C.

An artificial gene construct, a vector comprising the artificial gene construct, or an RNA molecule comprising an artificial gene construct modified to enable cellular uptake may be introduced into cells or administered directly to patients. In one aspect, an artificial gene construct or a vector comprising the artificial gene construct is introduced into cells ex vivo or in vivo. In a specific aspect, an artificial gene construct or vector is introduced into a cell(s) ex vivo and the cell(s) may be administered to a subject. Various techniques known to one of skill in the art may be used to introduce an artificial gene construct or vector comprising the artificial gene construct into a cell(s), such as electroporation, transfection, transformation, etc. In another aspect, an artificial gene construct or vector comprising the artificial gene construct is administered to a subject. The artificial gene construct or vector comprising the artificial gene construct may be administered to a subject by any technique known to one skilled in the art, e.g., intramuscularly, intravenously, subcutaneously, intradermally, topically, intrathecally, intraperitoneally, intratumorally, etc. In some aspects, the artificial gene construct or vector comprising the artificial gene construct is administered to a subject systemically. In other aspects, the artificial gene construct or vector comprising the artificial gene construct is administered to a subject locally.

Modifying Endogenous Genes

In another aspect, provided herein are method for modifying an endogenous gene such that the resulting gene contains a nucleotide sequence encoding an intronic REMS, or contains an additional nucleotide sequence encoding an intronic REMS (in other words, an intronic REMS not naturally found in the endogenous gene, i.e., a non-endogenous intronic REMS). In a specific aspect, provided herein are methods for modifying an endogenous gene such that the resulting gene contains a nucleotide sequence encoding an intronic REMS and contains a nucleotide sequence encoding a branch point and a nucleotide sequence encoding a 3' splice site upstream of the nucleotide sequence encoding the intronic REMS.

As used herein, the term "endogenous gene" refers to a gene naturally found in a cell or living subject. Techniques known to one of skill in the art can be used to introduce any one, two, or all of the following: a branch point, a 3' splice site, and an intronic REMS into an endogenous gene, e.g., the CRISPR-Cas approach, TALEN, or ZFN may be used. In certain aspects, a nucleotide sequence encoding an existing 5' splice site can be replaced with an intronic REMS or an intronic REMS may be inserted internally within an intron. In some aspects, care should be taken to introduce a nucleotide sequence encoding an intronic REMS into an endogenous gene so as not to disrupt an open reading frame or introduce a stop codon. The introduction of a nucleotide sequence encoding an intronic REMS into an endogenous gene may or may not result in an amino acid change at the protein level. In certain aspects, the introduction of a nucleotide sequence encoding an intronic REMS into an endogenous gene results in an amino acid change at the protein level. In some aspects, this amino acid change is a conservative amino acid substitution. In other aspects, the introduction of a nucleotide sequence encoding an intronic REMS into an endogenous gene does not result in an amino acid change at the protein level.

Kits

In one aspect, provided herein are kits comprising, in a container, an artificial gene construct or a vector comprising an artificial construct. In certain aspects, the kits further comprise a compound described herein, in a separate container, and/or a negative control, such as phosphate buffered saline or a compound that does not recognize an intronic REMS, in a separate container. In a specific aspect, the kits further comprise a positive control, such as a compound described herein as a positive control. In some aspects, the kits further comprise primers and/or antibodies, in one or more separate containers, for assessing the production of an mRNA transcript from an artificial gene construct and/or protein production therefrom.

In another aspect, provided herein are kits comprising, in one or more containers, the components and/or reagents necessary to produce an artificial gene construct and/or a vector comprising an artificial gene construct. In another aspect, provided herein are kits comprising, in one or more containers, the components and/or reagents necessary to modify an endogenous gene so that it contains a nucleotide sequence encoding an intronic REMS or an additional nucleotide sequence encoding an intronic REMS (in other words, a REMS not naturally found in the endogenous gene, i.e., a non-endogenous REMS). In another aspect, provided herein are kits comprising, in one or more containers, the components and/or reagents necessary to modify an endogenous gene so that the resulting gene contains a nucleotide sequence encoding an intronic REMS and contains a nucleotide sequence encoding a branch point and a nucleotide sequence encoding a 3' splice site upstream of the nucleotide sequence encoding the intronic REMS. In some aspects, the kits further comprise primers and/or antibodies, in one or more separate containers, for assessing the production of an mRNA transcript from a modified endogenous gene and/or protein production therefrom.

In another aspect, provided herein are kits comprising, in a container, a compound described herein, and instructions for use. In some aspects, the kits further comprise a negative control, such as phosphate buffered saline or a compound that does not recognize an intronic REMS, in a separate container.

EXAMPLES

To describe in more detail and assist in understanding the present description, the following non-limiting biological examples are offered to more fully illustrate the scope of the description and are not to be construed as specifically limiting the scope thereof. Such variations of the present description that may be now known or later developed, which would be within the purview of one skilled in the art to ascertain, are considered to fall within the scope of the present description and as hereinafter claimed. The example below illustrates the existence of an intronic recognition element for splicing modifier (REMS) that is important for the recognition of a compound described herein, and the binding of such a compound to the intronic REMS on a precursor RNA permits or enhances the splicing of the precursor RNA, and suggests the usefulness of the intronic REMS in combination with a compound described herein for modifying RNA splicing, and for modulating the amount of a gene product.

Materials and Methods
Cell Treatment:
GM04856 lymphocyte cells were diluted in a medium composed of DMEM, 10% FBS and 1× Pen/Strep to a concentration of 2.5e5 cells/mL. 2 mL (500K cells) were seeded in 6-well plates and recovered for 4h at 37° C., 5% $CO_2$. Compound dilutions were prepared as 2× compound stock in medium (e.g. for final 100 nM, make a 200 nM stock). After 4 h recovery, 2 mL of the 2× compound stock were added to each well, resulting in 4 mL/well with 1× final compound concentration. The cells were incubated for ~20 h at 37° C., 5% $CO_2$. After incubation, the cells were pelleted for 5 min at 1000 rpm. The supernatant was vacuum-removed and the cells were resuspended in 350 µL of RLT buffer (w/10 µL/mL beta-mercapto-ethanol, RNeasy kit). Total RNA was isolated using the RNeasy Mini Kit from Qiagen according to the manufacturer's instructions. The concentration of the resulting total RNA was determined using Nanodrop and diluted with water to a final concentration of 25 ng/µL.

Endpoint RT-PCR and RNAseq:
Analysis of alternatively spliced mRNAs in cultured cells
SH-SY5Y cells derived from a bone marrow biopsy of a female patient with neuroblastoma were plated at 600,000 cells/well in 2 mL DMEM with 10% FBS in 6-well plates, and incubated for 4 hours in a cell culture incubator (37° C., 5% $CO_2$, 100% relative humidity). Cells were then treated with Compound 64 at different concentrations (in 0.1% DMSO) for 24 hours. After removal of the supernatant, cells were lysed in RLT buffer with ß-mercaptoethanol and total RNA was extracted according to the manufacturer's protocol (RNeasy Mini Kit, Qiagen, Inc.).

One-step RT-PCR was performed using AgPath-ID™ One-Step RT-PCR Reagents (Life Technologies, Inc.) using 50 ng total RNA as input. The following PCR conditions were used: Step 1: 48° C. (15 min), Step 2: 95° C. (10 min), Step 3: 95° C. (30 sec), Step 4: 55° C. (30 sec), Step 5: 68° C. (1 min), repeat Steps 3 to 5 for 34 cycles, then hold at 4° C. The presence of iExons within alternatively spliced mRNAs was identified using primers listed in Tables 13 through 19, which correspond to FIGS. 2, 3, 4 and 5. PCR products were separated on 2% agarose E-gels (Life Technologies, Inc.), stained with ethidium bromide and visualized using a gel imager (UVP). Results for genes affected by intronic exons generated by treatment with Compound 64 are shown in Table 21 and Table 22 for SH-SY5Y cells treated with Compound 64 at 24 nm and 100 nm, respectively, and Table 23 for HD-1994 cells treated with Compound 64 at 100 nm.

For RNAseq, SH-SY5Y cells were treated as described above. Total RNA (3 µg) was used for stranded RNA library preparation and sequencing. The mRNA was enriched using oligo(dT) beads and then fragmented randomly by adding fragmentation buffer, then the cDNA was synthesized by using mRNA template and random hexamers primer, after which a custom second-strand synthesis buffer (Illumina), dNTPs, RNase H and DNA polymerase I were added to initiate the second-strand synthesis. After a series of terminal repair, ligation and sequencing adaptor ligation, the double-stranded cDNA library was completed through size selection and PCR enrichment. RNA libraries were sequenced in a HiSeq sequencer at >30M per sample, then 150 nt pair end reads were generated. The adapter-sequence containing reads were removed and the remaining reads were mapped to human genome (hg19) using STAR (version 2.5.1). Only uniquely mapped reads (with MAPQ>10) with <5 nt/100 nt mismatches and properly paired reads were used. The number of reads in the coding sequence (CDS) region of protein-coding genes and exonic region of non-coding genes were counted and analyzed using DESeq2 (Love et al., 2014). For splicing analysis, reads were counted for different exons annotated or not annotated but identified from RNA-seq. for each exon, a Percent-Spliced-In (PSI) value was calculated using the percent of average read number supporting the inclusion of the exon among all reads supporting either the inclusion or the exclusion of an exon. PSI differences between two samples were compared and Fisher's Exact Test was used to determine statistical significance. A PSI increase of >5% and P-value <0.01 was used to select statistically significant intronic exons being included by the compound.

Results:
Oligonucleotides corresponding to exons that flank the intron where an iExon is located were used to amplify total RNA purified from untreated (DMSO) or cells treated with Compound 64 (at dose levels 10 nM, 1 µM or 10 µM).

The resulting products were run on an agarose gel where the resulting bands of interest for each gene are shown by open and closed arrowheads, where an open arrowhead represents an exon isoform where endogenous wild-type splicing occurred; and, where a closed arrowhead represents an exon isoform where an iExon is included in the mRNA as shown in FIGS. 2A, 2B, 3A, 3B, 4A, 4B, 5A, 5B and 6A. In all cases, the increase of compound concentration resulted in the appearance of a slower migrating PCR product containing the intronic-derived exon, where the additional bands seen are intermediate spliced products. The asterisk (*) in each Figure represents an event where the targeted exon was skipped.

TABLE 13

Forward Primers for FIG. 2

| Gene | Forward Primer | Sequence 5'-3' | SEQ ID NO: |
|---|---|---|---|
| ABCB8 | ABCB_54-73 | GCCGGCGGCTCCTGTTTTAC | 3635 |
| ANXA11 | ANXA_101-120 | AGTCGCTGTACCACGACATC | 3636 |
| ARL15 | ARL1_87-106-1a-KE | GCTGCCGGATGTCTGATCTC | 3637 |
| ATG5 | ATG5_100-122-KE | ACGAATTCCAACTTGTTTCACGC | 3638 |
| BECN1 | BECN_53-72 | TTGACCATGCAATGGTGGCT | 3639 |
| C12orf4 | c12o_40-58 | GCCCAGGACTTCGGAACTA | 3640 |
| DENND4A | DENN_79-98-KE | GATCCGGGACAGCCCTTGTA | 3641 |
| DIAPH3 | DIAP_6-25 | CGGCAGAGTCTCAGTCCAAT | 3642 |
| EVC | EVC_61-80-KE | GGCACTGAGGCAGGAAAAGC | 3643 |
| FAM162A | FAM1_54-72 | GTCGGCGGAGTAGCAAGTG | 3644 |
| HTT | HTT_E49_For | TGCCCAGTCATTTGCACCTT | 3645 |
| MMS22L | MMS22Le14F1 | TGGTGTCTAAGAATGAGGAAATGGTA | 3646 |
| NIPA1 | NIPA1e4R1 | TTTGGGGAGTGGATAATCAGCA | 3647 |
| PAPD4 | PAPD_46-65-KE | CCCGGAGCAGTGATGGTGAT | 3648 |
| PDXDC1 | PDXD_23-42 | TGTGCCGTGTACCCTGTAAC | 3649 |
| RAF1 | RAF1_90-112-KE | CGACATCCACACCTAATGTCCAC | 3650 |
| SENP6 | SENP_12-36-KE | TCAGAGTCTAAGAGAGATGGAGGTT | 3651 |
| SF3B3 | SF3B-9a_122-143-KE | CTGGTTGATGAGTTGGACAGCC | 3652 |
| SF3B3 | SF3B-2a_84-105-KE | ACTTAACCTTGCAGAGAGCCAC | 3653 |
| TBCA | TBCA_21-39-KE | GCCTAAATAGCCGCAGCCT | 3654 |
| UBE2L3 | UBE2_18-36 | GCCAGCAGGAGGCTGATGA | 3655 |
| XRN2 | XRN2_28-47 | TTCACATCTGATGGCTCCCC | 3656 |
| ZFAND1 | ZFAN_9-32-KE | CCATTTGTGTGTGATGATTGTTCA | 3657 |

TABLE 14

Reverse Primers for FIG. 2

| Gene | Reverse Primer | Sequence 5'-3' | SEQ ID NO: |
|---|---|---|---|
| ABCB8 | ABCB_235-254 | AGGAGCTGCGGTAGCCATCA | 3658 |
| ANXA11 | ANXA_302-321 | GAGCCACCAGTCACTGTTCA | 3659 |
| ARL15 | ARL1_392-411-1a-KE | TGAGGCCTATGCAAACCAGG | 3660 |
| ATG5 | ATG5_329-351-KE | CAAGGAAGAGCTGAACTTGATGC | 3661 |
| BECN1 | BECN_205-225 | ACTGCCTCCTGTGTCTTCAAT | 3662 |

TABLE 14-continued

Reverse Primers for FIG. 2

| Gene | Reverse Primer | Sequence 5'-3' | SEQ ID NO: |
|---|---|---|---|
| C12orf4 | c12o_329-349 | TGACTGGCATTCTCTTGAACA | 3663 |
| DENND4A | DENN_197-220-KE | CCATACTTTTCAACAGTTCCTGGT | 3664 |
| DIAPH3 | DIAP_242-261 | GCGACTGGAGTCCTTGTTGA | 3665 |
| EVC | EVC_217-238-KE | AGGAAGAAGGTCAAGGAGGCAC | 3666 |
| FAM162A | FAM1_314-336 | CAGAGCTTCTGGTAAGCCTTAGA | 3667 |
| HTT | HTT_E51_Rev | GGGTATTTGTCCTTCTTTCT | 3668 |
| MMS22L | MMS22Le15F1 | CGCAAGTTGTGAGAAAGGCACTA | 3669 |
| NIPA1 | NIPA1e3F1 | GATGGTGTTCTGGATAAAAGCCT | 3670 |
| PAPD4 | PAPD_183-205-KE | AAGGTGAGTATATGCCGTGCTTC | 3671 |
| PDXDC1 | PDXD_179-199 | CAAGCAACAGGGGCAGTCTTC | 3672 |
| RAF1 | RAF1_249-269-KE | GGCTACTGGACAGGGCTGAAG | 3673 |
| SENP6 | SENP_158-177-KE | TGATGAACGGAGCTGTTGGC | 3674 |
| SF3B3 | SF3B-9a_283-303-KE | CCCCTACCACAGGCCACATAC | 3675 |
| SF3B3 | SF3B-2a_256-277-KE | ATGTACTTTGCCAGTGTTGGGG | 3676 |
| TBCA | TBCA_261-284-KE | GTCATAATTTTCACCGTCTTCAGC | 3677 |
| UBE2L3 | UBE2_163-182 | AGCCCTTGCCAAGTCAATAA | 3678 |
| XRN2 | XRN2_189-209 | TTGTAGTACCGCTGCTTCCAG | 3679 |
| ZFAND1 | ZFAN_146-167-KE | AAGTTCTCTCTCAGCACAGTCT | 3680 |

TABLE 15

Forward Primers for FIG. 3

| Gene | Forward Primer | Sequence 5'-3' | SEQ ID NO: |
|---|---|---|---|
| ACVR1B | ACVR_171-190KE | TACCAGACGGTCATGCTGCG | 3681 |
| AXIN1 | AXIN_198-217-KE | AAAAGAGAGCCAGCCGAGCA | 3682 |
| CENPI | CENP_177-201-KE | TCATCCTTCTTTCTTGAGTTACGCT | 3683 |
| DCAF17 | DCAF_84-103-KE | TTATCGGCGCTGTGTCAGCA | 3684 |
| FAM174A | FAM1_85-109-KE | GGATGATGAGGATGATGACAACACG | 3685 |
| FBL | FBL_99-118 | TGCTCGACACCCACACAAAT | 3686 |
| GNG12 | GNG1_17-39-KE | ACCTGAAAACATTGGACCACACA | 3687 |
| GXYLT1 | GXYL_57-77 | GGAAGCAATTGCCAAGAAGCA | 3688 |
| HMGXB4 | HMGX_829-848-KE | CTCCCAGCATCCCATACGCT | 3689 |
| IVD | IVD_40-60-KE | CTGGGGATGAGGGGCTCTAAC | 3690 |
| KDM6A | KDM6_94-116-KE | TGGCACGAAATATCAAGGTCTCA | 3691 |
| MADD | MADD_137-156-KE | TGCCACAGGAAAGGGTCCTA | 3692 |
| MRPL45 | MRP4_42-65 | AGGACTTCCCTGAAAAAGCTAAGG | 3693 |

TABLE 15-continued

Forward Primers for FIG. 3

| Gene | Forward Primer | Sequence 5'-3' | SEQ ID NO: |
|---|---|---|---|
| NSUN4 | NSUN_142-160-KE | AGGGGGACACCTATGACCG | 3694 |
| NUPL1 | NUPL_144-163 | GTCCACAGGGTTCTCCTTCG | 3695 |
| PPIP5K2 | PPIP_34-57-KE | TCAGTTGACCTATCTCCCTCATGG | 3696 |
| SOS2 | SOS2_86-107-KE | AACCTCGAAACTGCAAACAGCC | 3697 |
| STAT1 | STAT_68-88-KE | TTCCTGCTGCGGTTCAGTGAG | 3698 |
| STRN3 | STRN_95-115-KE | GTGAAGGAGCTGGAGAAGCAC | 3699 |
| TNS3 | TNS3_6-29-KE | CCAGGTGATAAACTTGTGATCGTG | 3700 |
| WNK1 | WNK1_45-67 | GCTGGTGTTTTTAAGATGGGACT | 3701 |

TABLE 16

Reverse Primers for FIG. 3

| Gene | Reverse Primer | Sequence 5'-3 | SEQ ID NO: |
|---|---|---|---|
| ACVR1B | ACVR_399-418-KE | TCAAACAGGGACCCGTGCTC | 3702 |
| AXIN1 | AXIN_398-417-KE | CCGCAGAAGTAGTACGCCAC | 3703 |
| CENPI | CENP_257-281-KE | CATTTACTGTCCTTTCTTCTGGGCT | 3704 |
| DCAF17 | DCAF_251-274-KE | GGGCATTCCCATAATAAAGCATCC | 3705 |
| FAM174A | FAM1_197-221-KE | GTTCTTTCATCAAAAGGCACATTCT | 3706 |
| FBL | FBL_285-304 | CCTCCATTACGCAGGAAGGT | 3707 |
| GNG12 | GNG1_199-218-KE | GGTGCTTGCTGTTTTGCTGG | 3708 |
| GXYLT1 | GXYL_246-268 | AGGAACGGATGTTGTCATCTTCA | 3709 |
| HMGXB4 | HMGX_1123-1144-KE | TTACAGAACACCTGGTAGGCCG | 3710 |
| IVD | IVD_290-311-KE | AGGTCCAGCCCACTCATCAGCA | 3711 |
| KDM6A | KDM6_265-287-KE | TGTCTGACATTGCTTCAGAGTTC | 3712 |
| MADD | MADD_288-309-KE | TCTCCTCTGTCTCACCAAGGTC | 3713 |
| MRPL45 | MRP4_198-222 | GGAAAACAGTGTTCAGTTACCAAGG | 3714 |
| NSUN4 | NSUN_317-338-KE | CTGTCGCTCCTTCTTCCTTGAC | 3715 |
| NUPL1 | NUPL_306-325 | AATTGAGCCCCACAGAAGGG | 3716 |
| PPIP5K2 | PPIP_149-172-KE | TTCACCTCCCCATTTTTAGAACCAA | 3717 |
| SOS2 | SOS2_281_301-KE | AATGGTGTTGGGTGACCTCGT | 3718 |
| STAT1 | STAT_279-300-KE | TGCGAATGATGTCAGGGAAAGT | 3719 |
| STRN3 | STRN_304-323-KE | GAAGGGATGTGGGCAGCTC | 3720 |
| TNS3 | TNS3_96-116-KE | CGGCTCCTTGTCCTTCAACAT | 3721 |
| WNK1 | WNK1_187-207 | CTGAGGACTCTGAGGTGCTGG | 3722 |

TABLE 17

Forward Primers for FIG. 4

| Gene | Forward Primer | Sequence 5'-3' | SEQ ID NO: |
|---|---|---|---|
| DCAF17 | DECA_23-43-KE | TGCTGTACCTTGCAGTGTTCC | 3723 |
| DHFR | DHFR_5-24 | CCATGAATCACCCAGGCCAT | 3724 |
| DMXL1 | DMXL_157-177-KE | GATTCACCACCCCACCCTGAT | 3725 |
| FER | FER_90-114-KE | ATCAGGTGTAGTTCTGCTGAATCCT | 3726 |
| FNDC3A | FNDC_27-48-KE | CCAAATGGTTCTGTGCCTCCTA | 3727 |
| GALC | GALC_106-130-KE | AGCGTTACCATGATTTGGACATTGA | 3728 |
| GBP1 | GBP1_155-175-KE | AGAAGTGCTAGAAGCCAGTGC | 3729 |
| HSD17B12 | HSD1_40-63-KE | TTTTGGATGTTCCTGACTTGGACA | 3730 |
| KIDINS220 | KIDI_82-106-KE | GAAAACATTCCTGCTCTGAAAGCTC | 3731 |
| LARP7 | LARP_211-231-KE | AGGATCCGGAGACGGAAATGT | 3732 |
| OXCT1 | OXCT_55-75-KE | GGCCTGACAGTGGATGACGTA | 3733 |
| SREK1 | SREK_85-106-KE | GCGAGTACGAGAAGCTCAGTCA | 3734 |
| SSBP1 | SSBP_27-51 | AAAAGAAAATAGAAGCCATGTTTCG | 3735 |
| STRADB | STRA_58-78 | TGTTCCACCAACGTTTCTCACTGTTCCACCAACGTTTCTCAC | 3736 |

TABLE 18

Reverse Primers for FIG. 4

| Gene | Reverse Primer | Sequence 5'-3' | SEQ ID NO: |
|---|---|---|---|
| DCAF17 | DECA_168-190-KE | CCATGAGACAAGGTAGCATCTGT | 3737 |
| DHFR | DHFR_209-228 | TGCCTTTCTCCTCCTGGACA | 3738 |
| DMXL1 | DMXL_342-366-KE | ATGACTACCACAAAGGCACTGATAA | 3739 |
| FER | FER_189-213-KE | TTGCCCAGTAATTCTCCCAATATGA | 3740 |
| FNDC3A | FNDC_178-198-KE | ACTGTGTGACTACCAGGGTGA | 3741 |
| GALC | GALC_238-258-KE | TTTCACTCGCTGGAGACCTTG | 3742 |
| GBP1 | GBP1_354-374-KE | CATTGGGCCTGTCATGTGGAT | 3743 |
| HSD17B12 | HSD1_164-184-KE | TGGATCTTTCCACCATGCCAG | 3744 |
| KIDINS220 | KIDI_303-322-KE | ATTGCCTTGTTCGGCAGCTA | 3745 |
| LARP7 | LARP_366-387-KE | CTGCAAGCACCTGTTTAACTCG | 3746 |
| OXCT1 | OXCT_236-256-KE | AATGAAAAACACGCAGCCTGG | 3747 |
| SREK1 | SREK_335-355-KE | GTATGGGAACGAGATCGACCG | 3748 |
| SSBP1 | SSBP_300-323 | TCTTTCAAGAACCAAACTGGTAGT | 3749 |
| STRADB | STRA_353-372 | GTTACCAGTGTTCCTGTGGG | 3750 |

TABLE 19

Forward Primers for FIG. 5

| Gene | Forward Primer | Sequence 5'-3' | SEQ ID NO: |
|---|---|---|---|
| ASAP1 | ASAP_64-38-19a-KE | TCACCAAAACCCACCCCTTC | 3751 |
| ATF6 | ATF6_65-85 | GAAGCCATCCGCAGAAGGGGA | 3752 |
| CRYL1 | CRYL_36-56-KE | CATGTCAGAAGGGTTGGGCAT | 3753 |
| CTNS | CTNS_14-33 | CCTCACTGTTCCTCCTGTCG | 3754 |
| DENND5A | DENN_178-199-8a-KE | CGGACACCTACTCTCCGTACAT | 3755 |
| DGKI | KGKI_81-101-KE | CCATGTGGAAAGAAACCCCGA | 3756 |
| DLGAP4 | DLGA_281-301-KE | AAGTGAACAAGGGACGCTGAC | 3757 |
| ELMO2 | ELMO_53-72-KE | TGCCACCACCGTCAGACATT | 3758 |
| ENTPD1 | ENTP_79-97-KE | TTGCTTGCTGTGGGGTTGAC | 3759 |
| ERGIC3 | ERGI_128-147-KE | GAAGGCTGCCAGGTGTATGG | 3760 |
| GNAQ | GNAQ_143-164-KE | CATGGACACACTCAAGATCCCA | 3761 |
| KIAA1524 | KIAA_107-129-KE | GGGATTTGGAACAAAGGTTGCAG | 3762 |
| KIAA1715 | KIAA_2-26 | TGAAGCATTGGATGATTTAAAATCC | 3763 |
| L3MBTL2 | L3MB_47-67-KE | TTACAAGGCTGCTCCCGTCAG | 3764 |
| LRRC42 | LRCC_190-211 | CCAGTGAATACTAGAGGGATCG | 3765 |
| MAN1A2 | MAN1_24-46-KE | ATTGGCTGAGAAACTCCTTCCTG | 3766 |
| MMS19 | MMS1_22-45-KE | CAGTGTTACAAGTTGTGGAAGCCC | 3767 |
| PMS1 | PMS1_104-127-KE | TCTCCTCATGAGCTTTGGTATCCT | 3768 |
| POMT2 | POMT_10-29 | ACCCTTCCTTCCCAGTGGAG | 3769 |
| PRPF31 | RPRF_50-69-KE | GCCAACCGTATGAGCTTCGG | 3770 |
| SKP1 | SKP1_56-75 | TCTTCCTTCGCTAACGCCTC | 3771 |
| STRN | STRN_84-105-KE | GAGAGAAAGGGAAAAAGGGGG | 3772 |
| STRN4 | STRN_33-52-4a-KE | GAGAACAGCCCGTTGGTGTG | 3773 |
| SUPT20H | SUPT_8-30-KE | AGCAAGGTTCAACCAGTCAAGAA | 3774 |
| TMEM214 | TMEM_55-75 | CCCACTTCTGGACTTTGCCTA | 3775 |
| UBAP2L | UBAP_60-79-KE | CCCTTTCCAACAGCCGAGTG | 3776 |
| VDAC2 | VDAC_25-48 | ATTGGAGTAGGCTATACTCAGACT | 3777 |
| VPS29 | VPS2_12-31-K3 | CGACGGTGGTGGTGACTGAG | 3778 |

TABLE 20 primers for FIG. 5

| Gene | Reverse Primer | Sequence 5'-3' | SEQ ID NO: |
|---|---|---|---|
| ASAP1 | ASAP_323-347-19a-KE | TGATGAAGTTGAACAGGTCTTCCTT | 3779 |
| ATF6 | ATF6_230-254 | TTGGTCTTGTGGTCTTGTTATGGGT | 3780 |
| CRYL1 | CRYL_215-235-KE | CTTCGCTGTATCTGTCGCAGT | 3781 |
| CTNS | CTNS_251-271 | TCGGGGAGCTCAAGGATAGTA | 3782 |
| DENND5A | DENN_380-400-8a-KE | TCAATTTTTGCCAGACGCAGC | 3783 |
| DGKI | DGKI_257-278-KE | ATGGGCATCAAATCCAAGGCTG | 3784 |

TABLE 20-continued primers for FIG. 5

| Gene | Reverse Primer | Sequence 5'-3' | SEQ ID NO: |
|---|---|---|---|
| DLGAP4 | DLGA_466-485-KE | CGGGACTGGGCTCCTCTTTT | 3785 |
| ELMO2 | ELMO_229-248-KE | TAATGGATGCCAGGGGCCGT | 3786 |
| ENTPD1 | ENTP_198-219-KE | AACTTGTGTGAGAAGAACCCGC | 3787 |
| ERGIC3 | ERGI_321-340-KE | CAGGGGGTTCACAATGCCTG | 3788 |
| GNAQ | GNAQ_273-296-KE | TTCTCAAAAGCAGACACCTTCTCC | 3789 |
| KIAA1524 | KIAA_383-405-KE | GCTTACTTCCATACCAGGAACCA | 3790 |
| KIAA1715 | KIAA_2889-2909 | TGAGTCCGGATCAAACCTTTC | 3791 |
| L3MBTL2 | L3MB_447-467-KE | TGAGCACCTCCACCTTCATCC | 3792 |
| LRRC42 | LRCC_339-359 | GTAAGACATTGCCTTGGTTGC | 3793 |
| MAN1A2 | MAN1-4503-4522-KE | AGCCCCAGTTTCGCCCTACT | 3794 |
| MMS19 | MMS1_260-280-KE | TTCTCCAGGAGCAAGGTGTGA | 3795 |
| PMS1 | PMS1_285-308-KE | ACATGAGAGCCATCTTGTGATCTG | 3796 |
| POMT2 | POMT_151-170 | CTGATAGTGCTTCCGGGTCA | 3797 |
| PRPF31 | RPRF_218-237-KE | TCGTTTACCTGTGTCTGCCG | 3798 |
| SKP1 | SKP1_290-314 | TGTGAAGATGAGTTCAGATCCAAAG | 3799 |
| STRN | STRN_277-296-KE | GGGTCTGGAAGGTGAACCCA | 3800 |
| STRN4 | STRN_171-190-4a-KE | TTGGACCGCATGTCGAGGAT | 3801 |
| SUPT20H | SUPT_216-235-KE | TGTTCTCGGCAGAGCCAAGC | 3802 |
| TMEM214 | TMEM_173-193 | AAATGCCAGCACTTTCAGTCG | 3803 |
| UBAP2L | UBAP_218-237-KE | CTCAGCCGTCCAGAAATGCT | 3804 |
| VDAC2 | VDAC_147-168 | AGCCCAACCTTGTGGCCTCCAG | 3805 |
| VPS29 | VPS2_203-220-KE | CCGGTGTGGGATGTGCAG | 3806 |

Results:

The RNA-seq data iExon production (ΔPSI) according to the Fisher's Exact Test (FET) in SH-SY5Y cells treated with Compound 64 at 24 nM (Table 21) and 100 nM (Table 22) and in HD-1994 human normal fibroblast line cells treated with Compound 64 at 100 nM (Table 23) providing the Log 2 based fold change of gene expression (Log 2FC) for each, where NA represents "Not Available." Analysis of RNA-seq data in HD1994 cells obtained from Palacino, et al., (Nat. Chem. Bio., 2015, (11) 511-517; NCBI-SRA Accession Number SRP055454).

The ΔPSI for modulated expression of RNA transcripts identified is represented by stars in Table 21, Table 22 and Table 23, where one star (*) represents ≤25% change in expression, where two stars () represent change in expression in a range from >25% to ≤50% change, where three stars (*) represent change in expression in a range from >50% to ≤75% change, and, where four stars (****) represent change in expression in a range from >75% to ≤100% change.

TABLE 21

Compound Effect in SHSY5Y Cells at 24 nm

| Gene | Inclusion Position | ΔPSI | FET ΔPSI | Log2FC |
|---|---|---|---|---|
| ADAL | i6 | * | 0.1 | −0.1 |
| ADAM23 | i24 |  | 0.9 | 0.0 |
| ADAM23 | i24 | * | 0.03 | 0.0 |
| ADAMTS19 | i18 | * | 4.00E−10 | −0.7 |
| ADAMTS19 | i10 | * | 1.00E−06 | −0.7 |
| AGPS | 12 | * | 0.001 | 0.0 |
| AKAP8L | i1 | * | 0.03 | 0.0 |
| ANKRD13C | i6 | * | 1 | 0.0 |
| ANXA11 | i16 | * | 2.00E−14 | −0.1 |
| ARL15 | i | *** | 2.00E−47 | 0.1 |
| ARL15 | i4 | * | 0.003 | 0.1 |
| ARSJ | i1 | * | 0.4 | 0.0 |
| BECN1 | i11 | * | 3.00E−76 | 0.0 |
| BIN3 | i2 | * | 5.00E−08 | 0.0 |
| BTBD10 | i4 | * | 0.03 | −0.1 |
| C11orf30 | i20 | * | 3.00E−07 | 0.0 |
| C12orf4 | i1 | ** | 8.00E−40 | 0.1 |
| C1orf27 | i1 | * | 9.00E−05 | 0.1 |
| C2orf47 | i5 | * | 0.5 | 0.2 |
| CACNB1 | i6 | * | 0.02 | 0.0 |
| CACNB4 | i6 | * | 0.003 | −0.1 |

TABLE 21-continued

Compound Effect in SHSY5Y Cells at 24 nm

| Gene | Inclusion Position | ΔPSI | FET ΔPSI | Log2FC |
|---|---|---|---|---|
| CADM2 | i4 | * | 1 | 0.1 |
| CDH18 | i4 | ** | 2.00E−04 | 0.0 |
| CENPI | i19 | | 0.6 | −0.1 |
| CEP162 | i2 | * | 3.00E−04 | 0.1 |
| CEP170 | i10 | * | 5.00E−15 | −0.2 |
| CEP192 | i13 | * | 7.00E−04 | 0.1 |
| CHEK1 | i13 | ** | 2.00E−26 | −0.3 |
| CHRM2 | i4 | * | 2.00E−05 | −0.2 |
| CMAHP | i6 | * | 3.00E−04 | −0.3 |
| CNRIP1 | i2 | * | 5.00E−44 | 0.1 |
| CNTN1 | i1 | * | 7.00E−15 | −0.6 |
| CRYBG3 | i17 | | 1 | −0.1 |
| CUX1 | i2 | * | 8.00E−07 | −0.1 |
| DAAM1 | i15 | * | 0.1 | −0.1 |
| DCAF17 | 12 | * | 7.00E−04 | 0.1 |
| DCAF17 | i6 | * | 0.4 | 0.1 |
| DCUN1D4 | i9 | * | 0.5 | 0.1 |
| DDX42 | i8 | * | 2.00E−14 | 0.0 |
| DENND1A | i10 | * | 0.2 | −0.1 |
| DENND4A | i30 | * | 4.00E−05 | −0.1 |
| DENND5A | i8 | * | 8.00E−04 | −0.1 |
| DET1 | i1 | * | 0.08 | 0.0 |
| DET1 | i1 | | 1 | 0.0 |
| DGKI | i19 | * | 0.4 | −0.2 |
| DHFR | i5 | ** | 3.00E−07 | −0.3 |
| DHFR | i5 | ** | 3.00E−11 | −0.3 |
| DIAPH3 | i15 | * | 9.00E−11 | −0.4 |
| DIAPH3 | i27 | * | 5.00E−05 | −0.4 |
| DLG5 | i20 | * | 6.00E−08 | −0.1 |
| DYRK1A | i3 | * | 6.00E−05 | 0.1 |
| DZIP1L | i15 | * | 0.02 | −0.2 |
| ELMO2 | i3 | **** | 0.004 | 0.0 |
| ENAH | i1 | * | 1.00E−17 | 0.3 |
| ENOX1 | i5 | * | 0.3 | 0.0 |
| ERC2 | i6 | | 1 | −0.1 |
| EVC | i5 | * | 2.00E−11 | −0.1 |
| FAM162A | i1 | * | 4.00E−26 | 0.1 |
| FAM174A | i2 | * | 2.00E−04 | 0.0 |
| FAM195B | i5 | | 0.8 | 0.0 |
| FAM208B | i1 | * | 0.006 | 0.1 |
| FAM69B | i1 | * | 9.00E−05 | 0.1 |
| FBXL16 | i2 | * | 5.00E−09 | −0.4 |
| FGD4 | i1 | * | 0.1 | −0.1 |
| FHOD3 | i21 | * | 2.00E−07 | −0.9 |
| GALC | i6 | * | 0.09 | −0.2 |
| GLCE | i2 | | 1 | 0.0 |
| GOLGB1 | i14 | * | 0.1 | −0.2 |
| GTSF1 | i2 | * | 0.003 | 0.0 |
| GXYLT1 | i7 | * | 7.00E−43 | 0.1 |
| HDAC5 | i14 | * | 0.09 | −0.3 |
| HDX | i1 | ** | 1.00E−11 | 0.2 |
| HTT | i49 | * | 1.00E−21 | −1.0 |
| IFT57 | i5 | * | 2.00E−15 | 0.2 |
| INO80 | i27 | * | 6.00E−05 | 0.0 |
| INVS | i3 | * | 3.00E−07 | 0.0 |
| KDM6A | i27 | * | 1.00E−16 | 0.2 |
| KIDINS220 | i2 | * | 0.008 | 0.0 |
| KIF21A | i1 | * | 1.00E−21 | 0.0 |
| L3MBTL2 | i5 | * | 0.09 | −0.4 |
| LINCR-0002 | i1 | * | 1.00E−07 | 0.0 |
| LINGO2 | i6 | * | 3.00E−05 | −0.2 |
| LOC400927 | i3 | ** | 0.02 | 0.0 |
| LPHN1 | i3 | * | 5.00E−11 | 0.0 |
| LRRC1 | i11 | * | 0.02 | −0.1 |
| LRRC42 | i2 | ** | 3.00E−35 | 0.0 |
| LYRM1 | i2 | * | 2.00E−12 | 0.2 |
| MACROD2 | i1 | * | 0.01 | −0.1 |
| MAPK10 | i2 | * | 0.1 | 0.0 |
| MARCH8 | i6 | * | 1.00E−04 | 0.0 |
| MDN1 | i91 | * | 0.1 | 0.0 |
| MEAF6 | i8 | ** | 1.00E−12 | 0.1 |
| MEMO1 | i6 | * | 1.00E−17 | −0.1 |
| MFN2 | i1 | * | 2.00E−08 | 0.0 |
| MLLT10 | i17 | * | 4.00E−11 | 0.0 |
| MRPL39 | i10 | * | 3.00E−06 | 0.1 |
| MRPL45 | i4 | * | 1.00E−09 | 0.1 |
| MRPS28 | i2 | * | 6.00E−12 | 0.1 |
| MTMR3 | i6 | * | 0.05 | 0.0 |
| MYB | i11 | * | 0.03 | 0.1 |
| MYCBP2 | i55 | ** | 2.00E−08 | 0.0 |
| MYCBP2 | i80 | * | 0.01 | 0.0 |
| MYLK | i5 | | 1 | −0.1 |
| NLGN1 | i4 | | 1 | −0.1 |
| NSUN4 | i5 | * | 0.5 | 0.0 |
| NUPL1 | i1 | * | 5.00E−45 | 0.2 |
| OSBPL3 | i1 | * | 0.3 | 0.0 |
| PAPD4 | i7 | ** | 1.00E−24 | −0.4 |
| PCDH10 | i1 | * | 0.002 | −0.2 |
| PDE3A | i2 | * | 6.00E−12 | −0.1 |
| PDE7A | i2 | ** | 4.00E−40 | 0.2 |
| PDXDC1 | i7 | * | 3.00E−21 | −0.1 |
| PDXDC2P | i7 | *** | 0.01 | 0.0 |
| PELI1 | i1 | * | 3.00E−05 | 0.0 |
| PITPNB | i7 | * | 3.00E−10 | −0.5 |
| PMS1 | i5 | * | 0.2 | 0.0 |
| POMT2 | i11 | ** | 5.00E−76 | 0.0 |
| PSMA4 | i4 | * | 3.00E−26 | 0.2 |
| RAB23 | i1 | * | 0.2 | 0.2 |
| RAF1 | i7 | * | 1.00E−28 | 0.0 |
| RASIP1 | i3 | | 1 | 0.0 |
| RCOR3 | i10 | * | 3.00E−07 | 0.0 |
| RERE | i13 | * | 0.04 | 0.1 |
| RNF130 | i8 | * | 0.05 | 0.1 |
| RNF144A | i2 | * | 0.008 | −0.1 |
| RNF213 | i26 | * | 0.3 | −0.3 |
| RPF2 | i1 | * | 1.00E−10 | 0.3 |
| RPS10 | i5 | * | 0.02 | 0.0 |
| SCO1 | i4 | * | 6.00E−06 | −0.1 |
| SENP6 | i2 | * | 2.00E−23 | 0.1 |
| SF3B3 | i2 | * | 5.00E−164 | 0.0 |
| SGMS1 | i2 | * | 0.5 | 0.1 |
| SGPL1 | i3 | * | 0.5 | −0.1 |
| SLC25A16 | i6 | * | 0.04 | 0.0 |
| SLC25A17 | i3 | * | 7.00E−10 | 0.0 |
| SNX24 | i1 | * | 5.00E−08 | −0.1 |
| SNX7 | i8 | * | 4.00E−12 | 0.1 |
| SORCS1 | i26 | * | 0.03 | −0.2 |
| SPIDR | i1 | * | 3.00E−07 | 0.0 |
| SPRYD7 | i4 | * | 5.00E−06 | −0.1 |
| SREK1 | i7 | * | 2.00E−08 | −0.2 |
| SSBP1 | i2 | * | 3.00E−104 | 0.1 |
| STRADB | i4 | * | 6.00E−06 | 0.0 |
| STXBP4 | i16 | | 1 | 0.0 |
| SUPT20H | i24 | * | 4.00E−08 | 0.1 |
| TAF2 | i23 | ** | 4.00E−42 | 0.1 |
| TARBP1 | i13 | * | 0.2 | 0.0 |
| TASP1 | i13 | * | 1.00E−04 | −0.1 |
| TBCA | i1 | * | 6.00E−88 | 0.1 |
| TCF4 | i4 | * | 7.00E−50 | −0.1 |
| TEKT4P2 | i2 | | 0.9 | 0.0 |
| TET1 | i8 | * | 3.00E−09 | −0.2 |
| TIAM1 | i4 | * | 1.00E−07 | −0.1 |
| TJP2 | i1 | * | 8.00E−06 | 0.2 |
| TMEM214 | i8 | * | 6.00E−06 | 0.0 |
| TNRC6A | i4 | * | 1.00E−27 | 0.0 |
| TRAF3 | i8 | * | 0.1 | 0.0 |
| TRIM65 | i5 | ** | 1.00E−22 | 0.0 |
| TSPAN7 | i1 | * | 0.02 | −0.3 |
| UBN2 | i6 | * | 0.6 | −0.1 |
| URGCP-MRPS24 | i1 | * | 7.00E−06 | 0.0 |
| UVRAG | i5 | * | 0.006 | −0.1 |
| WDR27 | i9 | ** | 1.00E−29 | −0.1 |
| WDR90 | i9 | * | 6.00E−06 | −0.2 |
| WNK1 | i23 | * | 4.00E−31 | 0.0 |
| XRN2 | i16 | * | 1.00E−24 | −0.5 |
| ZFP82 | i4 | * | 5.00E−16 | 0.1 |
| ZMIZ2 | i1 | * | 0.001 | 0.0 |
| ZNF138 | i3 | * | 1.00E−05 | 0.1 |
| ZNF208 | i3 | * | 0.4 | 0.0 |
| ZNF212 | i1 | * | 0.01 | 0.1 |

TABLE 21-continued

Compound Effect in SHSY5Y Cells at 24 nm

| Gene | Inclusion Position | ΔPSI | FET ΔPSI | Log2FC |
|---|---|---|---|---|
| ZNF280D | i19 | * | 0.2 | 0.0 |
| ZNF37BP | i4 | *** | 1.00E-31 | 0.0 |
| ZNF426 | i4 | * | 0.01 | 0.2 |
| ZNF618 | i11 | * | 2.00E-09 | -0.1 |
| ZNF680 | i3 | * | 2.00E-09 | 0.1 |
| ZNF730 | i3 | * | 0.04 | 0.1 |
| ZNF836 | i3 | * | 0.08 | -0.1 |
| ZSCAN25 | i2 | * | 0.02 | 0.0 |

TABLE 22

Compound Effect in SHSY5Y Cells at 100 nm

| Gene | Inclusion Position | ΔPSI | FET ΔPSI | Log2FC |
|---|---|---|---|---|
| ADAL | i6 | * | 7.00E-11 | -0.4 |
| ADAM23 | i24 | * | 9.00E-13 | 0.0 |
| ADAM23 | i24 | * | 2.00E-12 | 0.0 |
| ADAMTS19 | i18 | ** | 2.00E-23 | -1.3 |
| ADAMTS19 | i10 | * | 8.00E-23 | -1.3 |
| AGPS | i2 | * | 4.00E-14 | -0.3 |
| AKAP8L | i1 | * | 2.00E-19 | -0.1 |
| ANKRD13C | i6 | * | 6.00E-05 | -0.1 |
| ANXA11 | i16 | * | 1.00E-66 | -0.6 |
| ARL15 | i1 | **** | 9.00E-90 | 0.1 |
| ARL15 | i4 | * | 6.00E-04 | 0.1 |
| ARSJ | i1 | * | 2.00E-04 | 0.0 |
| BECN1 | i11 | ** | 3.00E-249 | 0.2 |
| BIN3 | i2 | * | 1.00E-18 | 0.0 |
| BTBD10 | i4 | * | 1.00E-13 | -0.3 |
| C11orf30 | i20 | * | 6.00E-20 | -0.1 |
| C12orf4 | i1 | **** | 2.00E-93 | 0.2 |
| C1orf27 | i1 | * | 9.00E-32 | 0.2 |
| C2orf47 | i5 | * | 2.00E-05 | 0.1 |
| CACNB1 | i6 | * | 2.00E-05 | 0.1 |
| CACNB4 | i6 | ** | 5.00E-10 | 0.0 |
| CADM2 | i4 | ** | 0.006 | 0.0 |
| CDH18 | i4 | **** | 1 | 0.0 |
| CENPI | i19 | * | 1.00E-10 | 0.0 |
| CEP162 | i2 | * | 1.00E-10 | 0.2 |
| CEP170 | i10 | * | 5.00E-43 | -0.6 |
| CEP192 | i13 | * | 0.002 | 0.1 |
| CHEK1 | i13 | ** | 9.00E-34 | -0.6 |
| CHRM2 | i4 | ** | 9.00E-14 | 0.1 |
| CMAHP | i6 | ** | 2.00E-05 | -0.3 |
| CNRIP1 | i2 | * | 7.00E-122 | 0.1 |
| CNTN1 | i1 | * | 3.00E-61 | 0.0 |
| CRYBG3 | i17 | * | 6.00E-08 | -0.1 |
| CUX1 | i2 | * | 1.00E-33 | -0.1 |
| DAAM1 | i15 | * | 6.00E-05 | -0.1 |
| DCAF17 | i2 | * | 7.00E-14 | 0.1 |
| DCAF17 | i6 | * | 5.00E-08 | 0.1 |
| DCUN1D4 | i9 | * | 9.00E-06 | 0.0 |
| DDX42 | i8 | * | 1.00E-54 | -0.2 |
| DENND1A | i10 | * | 5.00E-12 | -0.3 |
| DENND4A | i30 | ** | 3.00E-19 | 0.0 |
| DENND5A | i8 | * | 7.00E-35 | -0.6 |
| DET1 | i1 | * | 0.002 | 0.0 |
| DET1 | i1 | * | 6.00E-04 | 0.0 |
| DGKI | i19 | * | 2.00E-05 | -0.3 |
| DHFR | i5 | ** | 2.00E-10 | -0.8 |
| DHFR | i5 | ** | 4.00E-17 | -0.8 |
| DIAPH3 | i15 | * | 5.00E-19 | -1.1 |
| DIAPH3 | i27 | * | 1.00E-27 | -1.1 |
| DLG5 | i20 | * | 2.00E-43 | -0.4 |
| DYRK1A | i3 | * | 2.00E-10 | 0.1 |
| DZIP1L | i15 | * | 5.00E-05 | -0.2 |
| ELMO2 | i3 | **** | 5.00E-04 | 0.0 |
| ENAH | i1 | * | 8.00E-71 | 0.2 |
| ENOX1 | i5 | * | 2.00E-07 | 0.0 |
| ERC2 | i6 | *** | 9.00E-05 | -0.1 |
| EVC | i5 | ** | 5.00E-27 | -0.2 |
| FAM162A | i1 | * | 9.00E-88 | 0.1 |
| FAM174A | i2 | * | 8.00E-10 | 0.0 |
| FAM195B | i5 | * | 5.00E-08 | -0.2 |
| FAM208B | i1 | * | 7.00E-06 | 0.1 |
| FAM69B | i1 | * | 8.00E-06 | -0.1 |
| FBXL16 | i2 | * | 5.00E-13 | -0.5 |
| FGD4 | i1 | * | 4.00E-17 | 0.0 |
| FHOD3 | i21 | *** | 5.00E-37 | -1.2 |
| GALC | i6 | * | 4.00E-05 | -0.7 |
| GLCE | i2 | * | 0.001 | 0.1 |
| GOLGB1 | i14 | * | 2.00E-04 | -0.1 |
| GTSF1 | i2 | * | 1 | -0.1 |
| GXYLT1 | i7 | ** | 2.00E-103 | 0.1 |
| HDAC5 | i14 | * | 9.00E-07 | -0.5 |
| HDX | i1 | *** | 1.00E-37 | 0.3 |
| HTT | i49 | *** | 9.00E-62 | -1.4 |
| IFT57 | i5 | * | 3.00E-45 | 0.1 |
| INO80 | i27 | * | 6.00E-15 | -0.1 |
| INVS | i3 | * | 2.00E-10 | 0.1 |
| KDM6A | i27 | *** | 3.00E-47 | 0.3 |
| KIDINS220 | i2 | * | 2.00E-12 | 0.1 |
| KIF21A | i1 | * | 3.00E-79 | -0.1 |
| L3MBTL2 | i5 | * | 3.00E-11 | -0.9 |
| LINCR-0002 | i1 | * | 7.00E-12 | 0.0 |
| LINGO2 | i6 | * | 1.00E-05 | 0.0 |
| LOC400927 | i3 | *** | 3.00E-06 | 0.0 |
| LPHN1 | i3 | * | 2.00E-20 | -0.2 |
| LRRC1 | i11 | * | 3.00E-09 | -0.3 |
| LRRC42 | i2 | *** | 1.00E-92 | 0.0 |
| LYRM1 | i2 | * | 1.00E-56 | 0.4 |
| MACROD2 | i1 | *** | 3.00E-06 | 0.1 |
| MAPK10 | i2 | * | 4.00E-07 | -0.1 |
| MARCH8 | i6 | * | 5.00E-04 | 0.1 |
| MDN1 | i91 | * | 2.00E-10 | -0.1 |
| MEAF6 | i8 | *** | 3.00E-23 | 0.0 |
| MEMO1 | i6 | ** | 1.00E-62 | -0.5 |
| MFN2 | i1 | * | 1.00E-33 | 0.0 |
| MLLT10 | i17 | * | 3.00E-41 | -0.2 |
| MRPL39 | i10 | * | 3.00E-32 | 0.2 |
| MRPL45 | i4 | * | 3.00E-26 | 0.1 |
| MRPS28 | i2 | * | 1.00E-29 | 0.0 |
| MTMR3 | i6 | * | 1.00E-05 | 0.0 |
| MYB | i11 | * | 8.00E-07 | -0.1 |
| MYCBP2 | i55 | ** | 5.00E-13 | 0.1 |
| MYCBP2 | i80 | * | 3.00E-08 | 0.1 |
| MYLK | i5 | * | 9.00E-06 | -0.1 |
| NLGN1 | i4 | * | 4.00E-04 | -0.2 |
| NSUN4 | i5 | * | 2.00E-10 | -0.3 |
| NUPL1 | i1 | ** | 2.00E-125 | 0.3 |
| OSBPL3 | i1 | * | 2.00E-05 | 0.1 |
| PAPD4 | i7 | *** | 3.00E-58 | -0.7 |
| PCDH10 | i1 | * | 1.00E-10 | -0.2 |
| PDE3A | i2 | * | 2.00E-39 | 0.0 |
| PDE7A | i2 | *** | 1.00E-122 | 0.3 |
| PDXDC1 | i7 | ** | 4.00E-67 | -0.3 |
| PDXDC2P | i7 | **** | 1.00E-05 | 0.0 |
| PELI1 | i1 | * | 5.00E-11 | 0.1 |
| PITPNB | i7 | * | 2.00E-28 | -1.5 |
| PMS1 | i5 | * | 8.00E-22 | -0.4 |
| POMT2 | i11 | **** | 4.00E-165 | -0.2 |
| PSMA4 | i4 | * | 5.00E-69 | 0.2 |
| RAB23 | i1 | * | 7.00E-07 | 0.1 |
| RAF1 | i7 | * | 1.00E-104 | 0.0 |
| RASIP1 | i3 | **** | 0.01 | 0.0 |
| RCOR3 | i10 | * | 5.00E-19 | -0.2 |
| RERE | i13 | * | 3.00E-19 | -0.1 |
| RNF130 | i8 | * | 2.00E-04 | 0.1 |
| RNF144A | i2 | * | 2.00E-17 | 0.1 |
| RNF213 | i26 | * | 0.002 | -0.1 |
| RPF2 | i1 | * | 2.00E-41 | 0.2 |
| RPS10 | i5 | * | 0.005 | 0.0 |
| SCO1 | i4 | * | 3.00E-21 | -0.4 |
| SENP6 | i2 | ** | 1.00E-103 | 0.0 |
| SF3B3 | i2 | * | 0 | -0.1 |

TABLE 22-continued

Compound Effect in SHSY5Y Cells at 100 nm

| Gene | Inclusion Position | ΔPSI | FET ΔPSI | Log2FC |
|---|---|---|---|---|
| SGMS1 | i2 | * | 5.00E−05 | 0.1 |
| SGPL1 | i3 | * | 3.00E−04 | 0.1 |
| SLC25A16 | i6 | * | 7.00E−06 | −0.1 |
| SLC25A17 | i3 | * | 2.00E−39 | 0.0 |
| SNX24 | i1 | * | 3.00E−16 | 0.1 |
| SNX7 | i8 | * | 1.00E−75 | 0.1 |
| SORCS1 | i26 | * | 5.00E−05 | −0.3 |
| SPIDR | i1 | ** | 1.00E−29 | 0.0 |
| SPRYD7 | i4 | * | 2.00E−12 | −0.2 |
| SREK1 | i7 | * | 6.00E−32 | −0.6 |
| SSBP1 | i2 | * | 0 | 0.0 |
| STRADB | i4 | * | 8.00E−16 | 0.1 |
| STXBP4 | i16 | * | 1.00E−10 | 0.1 |
| SUPT20H | i24 | * | 9.00E−24 | 0.0 |
| TAF2 | i23 | *** | 3.00E−99 | 0.1 |
| TARBP1 | i13 | * | 0.005 | −0.2 |
| TASP1 | i13 | * | 2.00E−07 | 0.0 |
| TBCA | i1 | * | 5.00E−244 | 0.1 |
| TCF4 | i4 | * | 8.00E−125 | 0.0 |
| TEKT4P2 | i2 | * | 0.007 | 0.0 |
| TET1 | i8 | *** | 3.00E−18 | −0.4 |
| TIAM1 | i4 | *** | 4.00E−22 | −0.1 |
| TJP2 | i1 | * | 2.00E−25 | −0.1 |
| TMEM214 | i8 | * | 3.00E−50 | −0.1 |
| TNRC6A | i4 | ** | 6.00E−90 | 0.0 |
| TRAF3 | i8 | * | 4.00E−10 | −0.2 |
| TRIM65 | i5 | ** | 6.00E−28 | −0.1 |
| TSPAN7 | i1 | * | 2.00E−06 | −0.4 |
| UBN2 | i6 | * | 0.003 | −0.2 |
| URGCP-MRPS24 | i1 | ** | 2.00E−19 | 0.0 |
| UVRAG | i5 | * | 9.00E−06 | −0.2 |
| WDR27 | i9 | *** | 9.00E−64 | −0.2 |
| WDR90 | i9 | ** | 2.00E−16 | −0.2 |
| WNK1 | i23 | * | 3.00E−86 | 0.0 |
| XRN2 | i16 | * | 3.00E−78 | −1.1 |
| ZFP82 | i4 | ** | 2.00E−38 | 0.4 |
| ZMIZ2 | i1 | * | 1.00E−20 | 0.1 |
| ZNF138 | i3 | * | 2.00E−20 | 0.1 |
| ZNF208 | i3 | * | 0.005 | 0.0 |
| ZNF212 | i1 | * | 2.00E−10 | 0.0 |
| ZNF280D | i19 | * | 0.007 | 0.0 |
| ZNF37BP | i4 | **** | 6.00E−49 | 0.1 |
| ZNF426 | i4 | * | 2.00E−18 | 0.3 |
| ZNF618 | i11 | ** | 3.00E−37 | 0.0 |
| ZNF680 | i3 | ** | 7.00E−35 | 0.2 |
| ZNF730 | i3 | * | 5.00E−08 | 0.1 |
| ZNF836 | i3 | * | 1.00E−04 | 0.1 |
| ZSCAN25 | i2 | * | 2.00E−10 | 0.0 |

TABLE 23

Compound Effect in HD-1994 Cells at 100 nm

| Gene | Inclusion Position | ΔPSI | FETΔPSI | Log2FC |
|---|---|---|---|---|
| ABHD10 | i4 | * | 7.00E−22 | 0.2 |
| ADAM17 | i1 | * | 2.00E−11 | −0.4 |
| AGPAT4 | i1 | * | 1.00E−06 | −0.1 |
| AGPS | i2 | ** | 1.00E−51 | −1.6 |
| AKT1 | i1 | ** | 7.00E−36 | −0.1 |
| ANKRD13C | i6 | * | 4.00E−19 | −0.6 |
| ANXA11 | i16 | ** | 1.00E−185 | −1.4 |
| APIP | i1 | * | 2.00E−25 | 0.1 |
| APPL2 | i1 | * | 2.00E−28 | −2.2 |
| ARHGAP1 | i1 | * | 8.00E−63 | −0.7 |
| ARHGAP5 | i5 | ** | 5.00E−60 | −0.1 |
| ARL15 | i1 | **** | 9.00E−28 | −0.3 |
| ARL15 | i4 | ** | 3.00E−08 | −0.3 |
| ARL5B | i5 | * | 1.00E−04 | 0.0 |
| ASAP1 | i12 | **** | 3.00E−110 | −2.0 |
| ASAP1 | i19 | * | 5.00E−07 | −2.0 |

TABLE 23-continued

Compound Effect in HD-1994 Cells at 100 nm

| Gene | Inclusion Position | ΔPSI | FETΔPSI | Log2FC |
|---|---|---|---|---|
| ATF6 | i14 | ** | 2.00E−71 | 0.0 |
| BECN1 | i11 | *** | 0 | 0.1 |
| BHMT2 | i2 | *** | 4.00E−19 | −0.4 |
| BIN3 | i2 | ** | 3.00E−41 | −0.1 |
| BNC2 | i3 | * | 5.00E−07 | −0.2 |
| BTBD10 | i4 | * | 3.00E−16 | −1.0 |
| C10orf76 | i25 | * | 4.00E−18 | −0.2 |
| C11orf30 | i20 | ** | 7.00E−09 | −0.6 |
| C11orf73 | i2 | ** | 2.00E−12 | −0.9 |
| C12orf4 | i1 | **** | 9.00E−137 | 0.0 |
| C1orf27 | i1 | *** | 3.00E−52 | 0.1 |
| C1QTNF9B-AS1 | i1 | * | 0.002 | 0.1 |
| CCNL2 | i5 | * | 0.003 | 0.0 |
| CDH18 | i4 | ** | 1.00E−07 | −0.7 |
| CENPI | i19 | ** | 7.00E−24 | −0.1 |
| CEP57 | i1 | * | 6.00E−13 | −0.2 |
| CMSS1 | i1 | * | 2.00E−27 | −0.1 |
| CNOT7 | i2 | * | 1.00E−04 | 0.0 |
| COPS7B | i2 | * | 1.00E−16 | −0.5 |
| CRISPLD2 | i1 | * | 3.00E−06 | −0.6 |
| CUX1 | i2 | * | 6.00E−12 | −0.3 |
| DCAF17 | i2 | ** | 3.00E−14 | −0.9 |
| DDX42 | i8 | * | 1.00E−32 | −1.7 |
| DENND4A | i30 | ** | 9.00E−16 | 0.2 |
| DENND5A | i8 | * | 1.00E−43 | −1.9 |
| DENND5A | i3 | * | 4.00E−22 | −1.9 |
| DET1 | i1 | * | 7.00E−04 | 0.0 |
| DLG5 | i20 | * | 2.00E−13 | −1.5 |
| DMXL1 | i25 | * | 3.00E−06 | 0.0 |
| DNAJA4 | i2 | * | 0.001 | −0.3 |
| DNMBP | i1 | * | 4.00E−05 | −0.1 |
| ENAH | i1 | *** | 9.00E−267 | 0.2 |
| EP300 | i1 | * | 2.00E−16 | 0.2 |
| ERC1 | i18 | * | 9.00E−29 | −0.4 |
| EVC | i5 | **** | 1 00E−54 | 0.2 |
| EXOC3 | i12 | * | 4.00E−14 | −0.6 |
| EXOC6B | i21 | ** | 1.00E−20 | 0.0 |
| FAM162A | i1 | ** | 1.00E−50 | −0.2 |
| FAM174A | i2 | ** | 3.00E−22 | 0.5 |
| FAM208B | i1 | ** | 2.00E−08 | 0.2 |
| FAM49B | i1 | * | 3.00E−10 | −0.2 |
| FBN2 | i5 | * | 2.00E−78 | −0.6 |
| GBP1 | i1 | * | 7.00E−14 | −0.2 |
| GNG12 | i2 | * | 2.00E−152 | −0.1 |
| GXYLT1 | i7 | **** | 5.00E−86 | −1.0 |
| HDX | i1 | **** | 6.00E−10 | 0.5 |
| HMGXB4 | i6 | * | 3.00E−18 | −0.2 |
| HOXB3 | i1 | ** | 1.00E−05 | 0.1 |
| HSD17B4 | i2 | * | 3.00E−57 | 0.0 |
| IFT57 | i5 | ** | 4.00E−97 | 0.0 |
| IKBKAP | i1 | * | 1.00E−05 | 0.0 |
| INO80 | i27 | * | 1.00E−07 | −0.9 |
| INPP4B | i11 | * | 0.001 | −0.2 |
| ITCH | i2 | * | 3.00E−05 | −0.5 |
| IVD | i7 | ** | 7.00E−54 | −0.4 |
| KDM6A | i27 | **** | 1.00E−43 | −0.2 |
| KDSR | i9 | * | 2.00E−21 | −1.6 |
| KIAA1524 | i11 | *** | 1.00E−17 | −3.2 |
| KIAA1715 | i6 | ** | 2.00E−53 | −1.7 |
| KIDINS220 | i2 | ** | 5.00E−33 | 0.2 |
| L3MBTL2 | i5 | * | 4.00E−04 | −2.9 |
| LGALS3 | i1 | * | 2.00E−143 | −0.7 |
| LOC400927 | i3 | *** | 0.002 | −0.1 |
| LRRC42 | i2 | *** | 1.00E−103 | −0.2 |
| LYRM1 | i2 | *** | 1.00E−56 | 0.3 |
| MACROD2 | i1 | **** | 4.00E−04 | −0.2 |
| MANEA | i1 | * | 1.00E−21 | −0.3 |
| MARCH7 | i8 | * | 6.00E−26 | −0.3 |
| MARCH8 | i6 | * | 5.00E−08 | 0.0 |
| MEAF6 | i8 | **** | 3.00E−11 | −0.2 |
| MEMO1 | i6 | **** | 2.00E−35 | −1.2 |
| MFN2 | i1 | *** | 3.00E−127 | 0.1 |
| MMS19 | i2 | * | 5.00E−21 | −1.8 |
| MORF4L1 | i9 | *** | 0.002 | 0.0 |
| MRPL39 | i10 | * | 2.00E−36 | 0.2 |

TABLE 23-continued

Compound Effect in HD-1994 Cells at 100 nm

| Gene | Inclusion Position | ΔPSI | FETΔPSI | Log2FC |
|---|---|---|---|---|
| MRPL45 | i4 | * | 5.00E−34 | 0.1 |
| MRPS28 | i2 | * | 6.00E−10 | −0.1 |
| MYCBP2 | i55 | ** | 1.00E−08 | −0.2 |
| MYCBP2 | i80 | ** | 1.00E−16 | −0.2 |
| MYLK | i5 | * | 3.00E−45 | −0.4 |
| MZT1 | i1 | * | 3.00E−67 | −0.3 |
| NEDD4 | i21 | * | 2.00E−11 | −0.2 |
| NFASC | i28 | * | 1.00E−12 | 0.0 |
| NGF | i1 | *** | 4.00E−150 | 0.4 |
| NIPA1 | i3 | * | 3.00E−04 | 0.0 |
| NLN | i12 | * | 5.00E−15 | −1.4 |
| NREP | i3 | * | 1.00E−13 | −0.3 |
| NUPL1 | i1 | *** | 4.00E−146 | 0.3 |
| OSBPL3 | i1 | * | 3.00E−11 | −0.1 |
| PAPD4 | i7 | *** | 6.00E−61 | −1.9 |
| PBX3 | i8 | * | 1.00E−09 | −0.2 |
| PDE7A | i2 | *** | 9.00E−25 | −0.5 |
| PIGN | i22 | * | 8.00E−24 | 0.1 |
| PITPNB | i7 | * | 2.00E−04 | −4.0 |
| PNISR | i1 | * | 2.00E−17 | −0.1 |
| POMT2 | i11 | **** | 1.00E−182 | 0.0 |
| PPARG | i4 | * | 5.00E−09 | −0.5 |
| PPFIBP1 | i2 | * | 8.00E−13 | 0.0 |
| PRPF31 | i11 | * | 6.00E−27 | 0.1 |
| PSMA4 | i4 | * | 2.00E−14 | 0.1 |
| PXK | i1 | * | 2.00E−08 | −0.2 |
| RAB23 | i1 | * | 1.00E−16 | −0.7 |
| RAF1 | i7 | * | 2.00E−102 | −0.1 |
| RAPGEF1 | i11 | * | 2.00E−18 | 0.0 |
| RBBP8 | i6 | * | 5.00E−16 | −1.4 |
| RERE | i13 | *** | 3.00E−48 | −0.1 |
| RGL1 | i1 | * | 3.00E−05 | −0.2 |
| RPF2 | i1 | * | 1.00E−51 | 0.1 |
| SAMD4A | i3 | * | 3.00E−18 | −0.2 |
| SCO1 | i4 | * | 8.00E−26 | −1.3 |
| SENP6 | i2 | **** | 3.00E−77 | −0.5 |
| SF3B3 | i2 | *** | 0 | −0.1 |
| SGIP1 | i1 | * | 7.00E−12 | −0.1 |
| SH2B3 | i2 | * | 2.00E−07 | 0.1 |
| SKP1 | i1 | * | 2.00E−115 | −0.7 |
| SLC12A2 | i10 | * | 1.00E−08 | −0.1 |
| SLC25A17 | i3 | ** | 7.00E−66 | −0.4 |
| SMOX | i1 | * | 9.00E−06 | 0.0 |
| SNAP23 | i3 | * | 2.00E−27 | −0.7 |
| SNX24 | i1 | ** | 7.00E−27 | 0.1 |
| SNX7 | i8 | ** | 8.00E−203 | −0.1 |
| SOCS6 | i1 | * | 0.001 | −0.1 |
| SOGA2 | i15 | * | 2.00E−05 | NA |
| SPIDR | i1 | ** | 7.00E−19 | −0.3 |
| SSBP1 | i2 | * | 7.00E−75 | −0.3 |
| STRADB | i4 | ** | 2.00E−27 | 0.2 |
| STXBP6 | i1 | *** | 1.00E−39 | −0.5 |
| STXBP6 | i2 | * | 4.00E−21 | −0.5 |
| SUPT20H | i24 | * | 2.00E−23 | −0.5 |
| TAF2 | i23 | *** | 3.00E−58 | −0.6 |
| TAF2 | i20 | * | 2.00E−07 | −0.6 |
| TASP1 | i13 | ** | 5.00E−12 | −0.3 |
| TBCA | i1 | **** | 6.00E−246 | −0.3 |
| TBL1XR1 | i1 | * | 7.00E−09 | −0.2 |
| TCF4 | i4 | ** | 3.00E−42 | 0.0 |
| TJAP1 | i3 | * | 0.003 | 0.1 |
| TJP2 | i1 | * | 1.00E−22 | 0.0 |
| TMEM214 | i8 | ** | 0 | 0.0 |
| TMX3 | i5 | * | 2.00E−39 | −0.7 |
| TNRC6A | i4 | **** | 9.00E−54 | 0.0 |
| TXNL4B | i1 | * | 4.00E−06 | −0.1 |
| UBE2D3 | i1 | ** | 9.00E−07 | −0.1 |
| UBE2L3 | i1 | **** | 9.00E−54 | 0.2 |
| UNC13B | i7 | * | 4.00E−04 | 0.0 |
| URGCP-MRPS24 | i1 | *** | 7.00E−45 | 0.1 |
| VDAC2 | i10 | **** | 1.00E−08 | 0.1 |
| WHSC2 | i1 | * | 5.00E−14 | NA |
| WNK1 | i23 | *** | 1.00E−152 | 0.0 |
| XRN2 | i16 | ** | 3.00E−26 | −3.9 |
| ZFP82 | i4 | **** | 1.00E−26 | 0.8 |
| ZNF138 | i3 | **** | 8.00E−12 | −0.2 |
| ZNF350 | i4 | *** | 5.00E−07 | 0.8 |
| ZNF37BP | i4 | **** | 1.00E−05 | −0.2 |
| ZNF618 | i11 | ** | 9.00E−12 | −0.2 |
| ZNF680 | i3 | *** | 2.00E−06 | −0.4 |
| ZNF777 | i1 | ** | 0.001 | −0.1 |
| ZNF804A | i1 | * | 3.00E−08 | −0.1 |
| ZSCAN25 | i2 | * | 2.00E−04 | −0.1 |

Details on the location of the iExon produced in affected genes from Table 21, Table 22 and Table 23 are shown in Table 24.

TABLE 24

Gene Coordinates

| Gene | Coordinates (hg19) | Refseqid | Description |
|---|---|---|---|
| ABHD10 | chr3: +: 111709547: 111709598 | NM_018394 | abhydrolase domain containing 10 |
| ADAL | chr15: +: 43629554: 43629613 | NM_001159280 | adenosine deaminase-like |
| ADAM17 | chr2: −: 9683889: 9683825 | NM_003183 | ADAM metallopeptidase domain 17 |
| ADAM23 | chr2: +: 207470514: 207470604 | NM_003812 | ADAM metallopeptidase domain 23 |
| ADAM23 | chr2: +: 207472682: 207472728 | NM_003812 | ADAM metallopeptidase domain 23 |
| ADAMTS19 | chr5: +: 129023788: 129023907 | NM_133638 | ADAM metallopeptidase with thrombospondin type 1 motif, 19 |
| ADAMTS19 | chr5: +: 128959360: 128959434 | NM_133638 | ADAM metallopeptidase with thrombospondin type 1 motif, 19 |
| AGPAT4 | chr6: −: 161687802: 161687740 | NM_020133 | 1-acylglycerol-3-phosphate O-acyltransferase 4 (lysophosphatidic acid acyltransferase, delta) |
| AGPS | chr2: +: 178297714: 178297852 | NM_003659 | alkylglycerone phosphate synthase |
| AKAP8L | chr19: −: 15524082: 15523995 | NR_111971 | A kinase (PRKA) anchor protein 8-like |
| AKT1 | chr14: −: 105261053: | NM_001014432 | v-akt murine thymoma viral |

TABLE 24-continued

Gene Coordinates

| Gene | Coordinates (hg19) | Refseqid | Description |
|---|---|---|---|
| | 105260902 | | oncogene homolog 1 |
| ANKRD13C | chr1: −: 70767766: 70767706 | NM_030816 | ankyrin repeat domain 13C |
| ANXA11 | chr10: −: 81916254: 81916134 | NM_001278407 | annexin A11 |
| ANXA11 | chr10: −: 81916235: 81916134 | NM_145869 | annexin A11 |
| APIP | chr11: −: 34933660: 34933520 | NM_015957 | APAF1 interacting protein |
| APPL2 | chr12: −: 105625259: 105625147 | NM_018171 | adaptor protein, phosphotyrosine interaction, PH domain and leucine zipper containing 2 |
| ARHGAP1 | chr11: −: 46718619: 46718571 | NM_004308 | Rho GTPase activating protein 1 |
| ARHGAP5 | chr14: +: 32619665: 32619772 | NM_001173 | Rho GTPase activating protein 5 |
| ARL15 | chr5: −: 53603776: 53603718 | NM_019087 | ADP-ribosylation factor-like 15 |
| ARL15 | chr5: −: 53212951: 53212826 | NM_019087 | ADP-ribosylation factor-like 15 |
| ARL5B | chr10: +: 18963389: 18963454 | NM_178815 | ADP-ribosylation factor-like 5B |
| ARSJ | chr4: −: 114894867: 114894796 | NM_024590 | arylsulfatase family, member J |
| ASAP1 | chr8: −: 131173039: 131173031 | NM_001247996 | ArfGAP with SH3 domain, ankyrin repeat and PH domain 1 |
| ASAP1 | chr8: −: 131135828: 131135650 | NM_001247996 | ArfGAP with SH3 domain, ankyrin repeat and PH domain 1 |
| ATF6 | chr1: +: 161840762: 161840851 | NM_007348 | activating transcription factor 6 |
| BECN1 | chr17: −: 40963348: 40963310 | NM_003766 | beclin 1, autophagy related |
| BHMT2 | chr5: +: 78374568: 78374655 | NM_017614 | betaine--homocysteine S-methyltransferase 2 |
| BIN3 | chr8: −: 22501255: 22501165 | NM_018688 | bridging integrator 3 |
| BNC2 | chr9: −: 16672136: 16672064 | NM_017637 | basonuclin 2 |
| BTBD10 | chr11: −: 13440890: 13440824 | NM_032320 | BTB (POZ) domain containing 10 |
| C10orf76 | chr10: −: 103608231: 103608157 | NM_024541 | chromosome 10 open reading frame 76 |
| C11orf30 | chr11: +: 76259972: 76260061 | NM_020193 | chromosome 11 open reading frame 30 |
| C11orf73 | chr11: +: 86037555: 86037718 | NR_024596 | chromosome 11 open reading frame 73 |
| C12orf4 | chr12: −: 4646680: 4646546 | NM_020374 | chromosome 12 open reading frame 4 |
| C1orf27 | chr1: +: 186347618: 186347702 | NM_017847 | chromosome 1 open reading frame 27 |
| C1QTNF9B-AS1 | chr13: +: 24463289: 24463692 | NM_001014442 | C1QTNF9B antisense RNA 1 (non-protein coding) |
| C2orf47 | chr2: +: 200826550: 200826651 | NM_024520 | chromosome 2 open reading frame 47 |
| CACNB1 | chr17: −: 37342662: 37342603 | NM_000723 | calcium channel, voltage-dependent, beta 1 subunit |
| CACNB4 | chr2: −: 152728639: 152728497 | NM_000726 | calcium channel, voltage-dependent, beta 4 subunit |
| CADM2 | chr3: +: 85895854: 85895996 | NM_001256504 | cell adhesion molecule 2 |
| CCNL2 | chr1: −: 1328183: 1326677 | NM_030937 | cyclin L2 |
| CDH18 | chr5: −: 19938439: 19938387 | NM_001291956 | cadherin 18, type 2 |
| CENPI | chrX: +: 100411511: 100411544 | NM_006733 | centromere protein I |
| CEP162 | chr6: −: 84932759: 84932696 | NM_014895 | centrosomal protein 162 kDa |
| CEP170 | chr1: −: 243340118: 243340004 | NM_014812 | centrosomal protein 170 kDa |
| CEP192 | chr18: +: 13038514: 13038578 | NM_032142 | centrosomal protein 192 kDa |
| CEP57 | chr11: +: 95527385: 95527523 | NM_001243776 | centrosomal protein 57 kDa |
| CHEK1 | chr11: +: 125526101: 125526230 | NM_001114121 | checkpoint kinase 1 |

TABLE 24-continued

Gene Coordinates

| Gene | Coordinates (hg19) | Refseqid | Description |
|---|---|---|---|
| CHRM2 | chr7: +: 136686610: 136686804 | NM_001006626 | cholinergic receptor, muscarinic 2 |
| CMAHP | chr6: −: 25107418: 25107336 | NR_002174 | cytidine monophospho-N-acetylneuraminic acid hydroxylase, pseudogene |
| CMSS1 | chr3: +: 99770076: 99770147 | NM_032359 | NA |
| CNOT7 | chr8: −: 17101054: 17100951 | NM_013354 | CCR4-NOT transcription complex, subunit 7 |
| CNRIP1 | chr2: −: 68542975: 68542840 | NM_001111101 | cannabinoid receptor interacting protein 1 |
| CNTN1 | chr12: +: 41263098: 41263196 | NM_001843 | contactin 1 |
| COPS7B | chr2: +: 232655632: 232655883 | NM_022730 | COP9 constitutive photomorphogenic homolog subunit 7B (*Arabidopsis*) |
| CRISPLD2 | chr16: +: 84869783: 84870041 | NM_031476 | cysteine-rich secretory protein LCCL domain containing 2 |
| CRYBG3 | chr3: +: 97635177: 97635237 | NM_153605 | beta-gamma crystallin domain containing 3 |
| CUX1 | chr7: +: 101592135: 101592250 | NM_001202543 | cut-like homeobox 1 |
| DAAM1 | chr14: +: 59801175: 59801315 | NM_001270520 | dishevelled associated activator of morphogenesis 1 |
| DCAF17 | chr2: +: 172298369: 172298546 | NM_025000 | DDB1 and CUL4 associated factor 17 |
| DCAF17 | chr2: +: 172309926: 172309987 | NM_025000 | DDB1 and CUL4 associated factor 17 |
| DCUN1D4 | chr4: +: 52775086: 52775141 | NM_001287757 | DCN1, defective in cullin neddylation 1, domain containing 4 |
| DDX42 | chr17: +: 61883354: 61883511 | NM_007372 | DEAD (Asp-Glu-Ala-Asp) box helicase 42 ("DEAD" disclosed as SEQ ID NO: 3807) |
| DENND1A | chr9: −: 126385380: 126385322 | NM_020946 | DENN/MADD domain containing 1A |
| DENND4A | chr15: −: 65957563: 65957537 | NM_001144823 | DENN/MADD domain containing 4A |
| DENND5A | chr11: −: 9198449: 9198319 | NM_001243254 | DENN/MADD domain containing 5A |
| DENND5A | chr11: −: 9227781: 9227736 | NM_015213 | DENN/MADD domain containing 5A |
| DET1 | chr15: −: 89087925: 89087842 | NM_017996 | de-etiolated homolog 1 (*Arabidopsis*) |
| DET1 | chr15: −: 89088400: 89088342 | NM_017996 | de-etiolated homolog 1 (*Arabidopsis*) |
| DGKI | chr7: −: 137249412: 137249362 | NM_004717 | diacylglycerol kinase, iota |
| DHFR | chr5: −: 79929807: 79929696 | NM_000791 | dihydrofolate reductase |
| DHFR | chr5: −: 79928121: 79928051 | NM_000791 | dihydrofolate reductase |
| DIAPH3 | chr13: −: 60548266: 60548219 | NM_001042517 | diaphanous-related formin 3 |
| DIAPH3 | chr13: −: 60266972: 60266851 | NM_001042517 | diaphanous-related formin 3 |
| DLG5 | chr10: −: 79572531: 79572471 | NM_004747 | discs, large homolog 5 (*Drosophila*) |
| DMXL1 | chr5: +: 118508106: 118508210 | NM_005509 | Dmx-like 1 |
| DNAJA4 | chr15: +: 78557823: 78558635 | NM_018602 | DnaJ (Hsp40) homolog, subfamily A, member 4 |
| DNMBP | chr10: −: 101762780: 101762699 | NM_015221 | dynamin binding protein |
| DYRK1A | chr21: +: 38794884: 38794954 | NM_101395 | dual-specificity tyrosine-(Y)-phosphorylation regulated kinase 1A |
| DZIP1L | chr3: −: 137783162: 137783023 | NM_173543 | DAZ interacting zinc finger protein 1-like |
| ELMO2 | chr20: −: 45023043: 45022947 | NM_133171 | engulfment and cell motility 2 |
| ENAH | chr1: −: 225788060: 225787910 | NM_001008493 | enabled homolog (*Drosophila*) |
| ENAH | chr1: −: 225788064: 225787910 | NM_001008493 | enabled homolog (*Drosophila*) |
| ENOX1 | chr13: −: 43984398: 43984311 | NM_017993 | ecto-NOX disulfide-thiol exchanger 1 |
| EP300 | chr22: +: 41496302: 41496407 | NM_001429 | E1A binding protein p300 |

TABLE 24-continued

| Gene | Coordinates (hg19) | Refseqid | Description |
|---|---|---|---|
| | Gene Coordinates | | |
| ERC1 | chr12: +: 1536281: 1536343 | NR_027948 | ELKS/RAB6-interacting/CAST family member 1 |
| ERC2 | chr3: −: 56159162: 56159019 | NM_015576 | ELKS/RAB6-interacting/CAST family member 2 |
| EVC | chr4: +: 5743061: 5743168 | NM_153717 | Ellis van Creveld protein |
| EXOC3 | chr5: +: 466496: 466667 | NM_007277 | exocyst complex component 3 |
| EXOC6B | chr2: −: 72410034: 72410023 | NM_015189 | exocyst complex component 6B |
| FAM162A | chr3: +: 122120223: 122120382 | NM_014367 | family with sequence similarity 162, member A |
| FAM174A | chr5: +: 99917051: 99917108 | NM_198507 | family with sequence similarity 174, member A |
| FAM195B | chr17: −: 79781381: 79781288 | NM_001288798 | family with sequence similarity 195, member B |
| FAM208B | chr10: +: 5751493: 5751626 | NM_017782 | family with sequence similarity 208, member B |
| FAM49B | chr8: −: 130937848: 130937794 | NM_016623 | family with sequence similarity 49, member B |
| FAM69B | chr9: +: 139611405: 139611665 | NM_152421 | family with sequence similarity 69, member B |
| FBN2 | chr5: −: 127850450: 127850370 | NM_001999 | fibrillin 2 |
| FBXL16 | chr16: −: 746433: 746287 | NM_153350 | F-box and leucine-rich repeat protein 16 |
| FGD4 | chr12: +: 32664764: 32664843 | NM_139241 | FYVE, RhoGEF and PH domain containing 4 |
| FHOD3 | chr18: +: 34322340: 34322431 | NM_001281740 | formin homology 2 domain containing 3 |
| GALC | chr14: −: 88447791: 88447758 | NM_001201402 | galactosylceramidase |
| GBP1 | chr1: −: 89530504: 89530384 | NM_002053 | guanylate binding protein 1, interferon-inducible |
| GLCE | chr15: +: 69517534: 69517591 | NM_015554 | glucuronic acid epimerase |
| GNG12 | chr1: −: 68179430: 68179375 | NM_018841 | guanine nucleotide binding protein (G protein), gamma 12 |
| GOLGB1 | chr3: −: 121401810: 121401764 | NM_001256486 | golgin B1 |
| GTSF1 | chr12: −: 54862737: 54862609 | NM_144594 | gametocyte specific factor 1 |
| GXYLT1 | chr12: −: 42489016: 42488953 | NM_173601 | glucoside xylosyltransferase 1 |
| HDAC5 | chr17: −: 42163619: 42163517 | NM_001015053 | histone deacetylase 5 |
| HDX | chrX: −: 83756519: 83756437 | NM_001177479 | highly divergent homeobox |
| HMGXB4 | chr22: +: 35663361: 35663507 | NR_027780 | HMG box domain containing 4 |
| HOXB3 | chr17: −: 46648520: 46648451 | NM_002146 | homeobox B3 |
| HSD17B4 | chr5: +: 118792986: 118793063 | NM_001199291 | hydroxy steroid (17-beta) dehydrogenase 4 |
| HTT | chr4: +: 3215349: 3215463 | NM_002111 | huntingtin |
| IFT57 | chr3: −: 107911373: 107911323 | NM_018010 | intraflagellar transport 57 |
| IKBKAP | chr9: −: 111695687: 111695551 | NM_003640 | inhibitor of kappa light polypeptide gene enhancer in B-cells, kinase complex-associated protein |
| INO80 | chr15: −: 41305472: 41305408 | NM_017553 | INO80 complex subunit |
| INPP4B | chr4: −: 143190586: 143190485 | NM_003866 | inositol polyphosphate-4-phosphatase, type II, 105 kDa |
| INVS | chr9: +: 102970748: 102970845 | NM_183245 | inversin |
| ITCH | chr20: +: 32980543: 32980720 | NM_001257137 | itchy E3 ubiquitin protein ligase homolog (mouse) |
| IVD | chr15: +: 40706571: 40706723 | NM_002225 | isovaleryl-CoA dehydrogenase |
| KDM6A | chrX: +: 44965787: 44965894 | NM_001291415 | lysine (K)-specific demethylase 6A |
| KDSR | chr18: −: 61002332: 61002156 | NM_002035 | 3-ketodihydrosphingosine reductase |
| KIAA1524 | chr3: −: 108284925: | NM_020890 | KIAA1524 |

TABLE 24-continued

Gene Coordinates

| Gene | Coordinates (hg19) | Refseqid | Description |
|---|---|---|---|
| | 108284745 | | |
| KIAA1715 | chr2: −: 176835145: 176834927 | NM_030650 | KIAA1715 |
| KIDINS220 | chr2: −: 8961232: 8961097 | NM_020738 | kinase D-interacting substrate, 220 kDa |
| KIF21A | chr12: −: 39835889: 39835764 | NM_001173464 | kinesin family member 21A |
| L3MBTL2 | chr22: +: 41613520: 41613848 | NM_031488 | l(3)mbt-like 2 (*Drosophila*) |
| LGALS3 | chr14: +: 55596173: 55596365 | NM_001177388 | lectin, galactoside-binding, soluble, 3 |
| LINCR-0002 | chr3: +: 191191340: 191191477 | NR_120606 | uncharacterized LincR-0002 |
| LINGO2 | chr9: −: 28080976: 28080822 | NM_001258282 | leucine rich repeat and Ig domain containing 2 |
| LOC400927 | chr22: −: 38766050: 38765991 | NR_002821 | TPTE and PTEN homologous inositol lipid phosphatase pseudogene |
| LPHN1 | chr19: −: 14284211: 14284108 | NM_001008701 | adhesion G protein-coupled receptor L1 |
| LRRC1 | chr6: +: 53784070: 53784138 | NM_018214 | leucine rich repeat containing 1 |
| LRRC42 | chr1: +: 54413535: 54413654 | NM_001256409 | leucine rich repeat containing 42 |
| LYRM1 | chr16: +: 20922505: 20922586 | NM_001128301 | LYR motif containing 1 |
| MACROD2 | chr20: +: 13976991: 13977165 | NM_080676 | MACRO domain containing 2 |
| MANEA | chr6: +: 96029731: 96029787 | NM_024641 | mannosidase, endo-alpha |
| MAPK10 | chr4: −: 87168720: 87168646 | NM_002753 | mitogen-activated protein kinase 10 |
| MARCH7 | chr2: +: 160619771: 160619867 | NM_022826 | membrane-associated ring finger (C3HC4) 7 |
| MARCH8 | chr10: −: 45955325: 45955188 | NM_001282866 | membrane-associated ring finger (C3HC4) 8, E3 ubiquitin protein ligase |
| MDN1 | chr6: −: 90366293: 90366095 | NM_014611 | midasin AAA ATPase 1 |
| MEAF6 | chr1: −: 37959764: 37959741 | NR_073092 | MYST/Esa1-associated factor 6 |
| MEMO1 | chr2: −: 32112156: 32112104 | NM_015955 | Methylation modifier for class I HLA |
| MFN2 | chr1: +: 12041867: 12041910 | NM_014874 | mitofusin 2 |
| MLLT10 | chr10: +: 22017561: 22017604 | NM_004641 | myeloid/lymphoid or mixed-lineage leukemia; translocated to, 10 |
| MMS19 | chr10: −: 99241240: 99241106 | NM_022362 | MMS19 nucleotide excision repair homolog (*S. cerevisiae*) |
| MORF4L1 | chr15: +: 79184787: 79184819 | NM_206839 | mortality factor 4 like 1 |
| MRPL39 | chr21: −: 26960065: 26960013 | NM_080794 | mitochondrial ribosomal protein L39 |
| MRPL45 | chr17: +: 36468550: 36468624 | NM_032351 | mitochondrial ribosomal protein L45 |
| MRPS28 | chr8: −: 80915355: 80915234 | NM_014018 | mitochondrial ribosomal protein S28 |
| MTMR3 | chr22: +: 30384868: 30384916 | NM_021090 | myotubularin related protein 3 |
| MYB | chr6: +: 135520664: 135520719 | NM_001161656 | v-myb avian myeloblastosis viral oncogene homolog |
| MYCBP2 | chr13: −: 77692630: 77692475 | NM_015057 | MYC binding protein 2, E3 ubiquitin protein ligase |
| MYCBP2 | chr13: −: 77628142: 77628054 | NM_015057 | MYC binding protein 2, E3 ubiquitin protein ligase |
| MYLK | chr3: −: 123459382: 123459323 | NM_053025 | myosin light chain kinase |
| MZT1 | chr13: −: 73299916: 73299780 | NM_001071775 | mitotic spindle organizing protein 1 |
| NEDD4 | chr15: −: 56132413: 56132348 | NM_006154 | neural precursor cell expressed, developmentally down-regulated 4 |
| NFASC | chr1: +: 204980621: 204980739 | NM_001005388 | neurofascin |
| NGF | chr1: −: 115843104: 115843018 | NM_002506 | nerve growth factor (beta polypeptide) |
| NIPA1 | chr15: −: 23053780: 23053689 | NM_001142275 | non imprinted in Prader-Willi/Angelman syndrome 1 |

TABLE 24-continued

Gene Coordinates

| Gene | Coordinates (hg19) | Refseqid | Description |
|---|---|---|---|
| NLGN1 | chr3: +: 173946047: 173946101 | NM_014932 | neuroligin 1 |
| NLN | chr5: +: 65118355: 65118497 | NM_020726 | neurolysin (metallopeptidase M3 family) |
| NREP | chr5: −: 111086122: 111086049 | NM_001142476 | NA |
| NSUN4 | chr1: +: 46823248: 46823331 | NR_045789 | NOP2/Sun domain family, member 4 |
| NUPL1 | chr13: +: 25877240: 25877293 | NM_014089 | nucleoporin 58 kDa |
| OSBPL3 | chr7: −: 24938340: 24938132 | NM_015550 | oxysterol binding protein-like 3 |
| PAPD4 | chr5: +: 78937278: 78937340 | NM_001114393 | PAP associated domain containing 4 |
| PBX3 | chr9: +: 128726317: 128726477 | NM_006195 | pre-B-cell leukemia homeobox 3 |
| PCDH10 | chr4: +: 134074437: 134074588 | NM_032961 | protocadherin 10 |
| PDE3A | chr12: +: 20755159: 20755255 | NM_000921 | phosphodiesterase 3A, cGMP-inhibited |
| PDE7A | chr8: −: 66693182: 66693079 | NM_001242318 | phosphodiesterase 7A |
| PDXDC1 | chr16: +: 15103356: 15103418 | NM_001285447 | pyridoxal-dependent decarboxylase domain containing 1 |
| PDXDC2P | chr16: −: 70065151: 70065089 | NR_003610 | pyridoxal-dependent decarboxylase domain containing 2, pseudogene |
| PELI1 | chr2: −: 64339806: 64339697 | NM_020651 | pellino E3 ubiquitin protein ligase 1 |
| PIGN | chr18: −: 59764997: 59764914 | NM_176787 | phosphatidylinositol glycan anchor biosynthesis, class N |
| PITPNB | chr22: −: 28290410: 28290364 | NM_012399 | phosphatidylinositol transfer protein, beta |
| PITPNB | chr22: −: 28288318: 28288117 | NM_012399 | phosphatidylinositol transfer protein, beta |
| PMS1 | chr2: +: 190683464: 190683555 | NM_000534 | PMS1 homolog 1, mismatch repair system component |
| PNISR | chr6: −: 99868460: 99868399 | NM_032870 | PNN-interacting serine/arginine-rich protein |
| POMT2 | chr14: −: 77753614: 77753576 | NM_013382 | protein-O-mannosyltransferase 2 |
| PPARG | chr3: +: 12427535: 12427591 | NM_138712 | peroxisome proliferator-activated receptor gamma |
| PPFIBP1 | chr12: +: 27769294: 27769423 | NM_003622 | PTPRF interacting protein, binding protein 1 (liprin beta 1) |
| PRPF31 | chr19: +: 54632112: 54632180 | NM_015629 | PRP31 pre-mRNA processing factor 31 homolog (S. cerevisiae) |
| PSMA4 | chr15: +: 78834918: 78834987 | NM_001102667 | proteasome subunit alpha 4 |
| PXK | chr3: +: 58321084: 58321179 | NM_017771 | PX domain containing serine/threonine kinase |
| RAB23 | chr6: −: 57086244: 57086117 | NM_001278666 | RAB23, member RAS oncogene family |
| RAB23 | chr6: −: 57086244: 57086141 | NM_016277 | RAB23, member RAS oncogene family |
| RAF1 | chr3: −: 12645036: 12644977 | NM_002880 | Raf-1 proto-oncogene, serine/threonine kinase |
| RAPGEF1 | chr9: −: 134479440: 134479348 | NM_005312 | Rap guanine nucleotide exchange factor (GEF) 1 |
| RASIP1 | chr19: −: 49241364: 49241141 | NM_017805 | Ras interacting protein 1 |
| RBBP8 | chr18: +: 20557753: 20557850 | NM_002894 | retinoblastoma binding protein 8 |
| RCOR3 | chr1: +: 211478332: 211478493 | NM_001136223 | REST corepressor 3 |
| RERE | chr1: −: 8456591: 8456504 | NM_012102 | arginine-glutamic acid dipeptide (RE) repeats |
| RGL1 | chr1: +: 183708924: 183709042 | NM_015149 | ral guanine nucleotide dissociation stimulator-like 1 |
| RNF130 | chr5: −: 179390561: 179390471 | NM_018434 | ring finger protein 130 |
| RNF144A | chr2: +: 7114066: 7114154 | NM_014746 | ring finger protein 144A |
| RNF213 | chr17: +: 78316103: 78316182 | NM_001256071 | ring finger protein 213 |
| RPF2 | chr6: +: 111305510: 111305566 | NM_032194 | ribosome production factor 2 homolog |

TABLE 24-continued

Gene Coordinates

| Gene | Coordinates (hg19) | Refseqid | Description |
|---|---|---|---|
| RPS10 | chr6: −: 34385674: 34385575 | NM_001204091 | ribosomal protein S10 |
| SAMD4A | chr14: +: 55204147: 55204227 | NM_015589 | sterile alpha motif domain containing 4A |
| SCO1 | chr17: −: 10594966: 10594907 | NM_004589 | SCO1 cytochrome c oxidase assembly protein |
| SENP6 | chr6: +: 76331643: 76331687 | NM_015571 | SUMO1/sentrin specific peptidase 6 |
| SF3B3 | chr16: +: 70561279: 70561332 | NM_012426 | splicing factor 3b, subunit 3, 130 kDa |
| SGIP1 | chr1: +: 67051355: 67051531 | NM_032291 | SH3-domain GRB2-like (endophilin) interacting protein 1 |
| SGMS1 | chr10: −: 52328405: 52328298 | NM_147156 | sphingomyelin synthase 1 |
| SGPL1 | chr10: +: 72604233: 72604395 | NM_003901 | sphingosine-1-phosphate lyase 1 |
| SH2B3 | chr12: +: 111859705: 111859739 | NM_005475 | SH2B adaptor protein 3 |
| SKP1 | chr5: −: 133511076: 133510975 | NM_170679 | S-phase kinase-associated protein 1 |
| SLC12A2 | chr5: +: 127478818: 127478874 | NM_001046 | solute carrier family 12 (sodium/potassium/chloride transporters), member 2 |
| SLC25A16 | chr10: −: 70250796: 70250680 | NM_152707 | solute carrier family 25 (mitochondrial carrier), member 16 |
| SLC25A17 | chr22: −: 41193340: 41193288 | NR_104235 | solute carrier family 25 (mitochondrial carrier; peroxisomal membrane protein, 34 kDa), member 17 |
| SMOX | chr20: +: 4133445: 4133558 | NM_175842 | spermine oxidase |
| SNAP23 | chr15: +: 42805372: 42805407 | NM_003825 | synaptosomal-associated protein, 23 kDa |
| SNX24 | chr5: +: 122233837: 122233931 | NM_014035 | sorting nexin 24 |
| SNX7 | chr1: +: 99204216: 99204359 | NM_015976 | sorting nexin 7 |
| SOCS6 | chr18: +: 67981331: 67981476 | NM_004232 | suppressor of cytokine signaling 6 |
| SOGA2 | chr18: +: 8828355: 8828467 | NM_015210 | NA |
| SORCS1 | chr10: −: 108337396: 108337339 | NM_001206572 | sortilin-related VPS10 domain containing receptor 1 |
| SPIDR | chr8: +: 48185929: 48186042 | NM_001080394 | scaffolding protein involved in DNA repair |
| SPRYD7 | chr13: −: 50492357: 50492229 | NM_020456 | SPRY domain containing 7 |
| SREK1 | chr5: +: 65460436: 65460505 | NM_001270492 | splicing regulatory glutamine/lysine-rich protein 1 |
| SSBP1 | chr7: +: 141441110: 141441259 | NR_046269 | single-stranded DNA binding protein 1, mitochondrial |
| STRADB | chr2: +: 202335632: 202335834 | NM_018571 | STE20-related kinase adaptor beta |
| STXBP4 | chr17: +: 53193279: 53193304 | NM_178509 | syntaxin binding protein 4 |
| STXBP6 | chr14: −: 25457178: 25457092 | NM_014178 | syntaxin binding protein 6 (amisyn) |
| STXBP6 | chr14: −: 25411028: 25410930 | NM_014178 | syntaxin binding protein 6 (amisyn) |
| SUPT20H | chr13: −: 37585794: 37585696 | NM_001014286 | suppressor of Ty 20 homolog (*S. cerevisiae*) |
| TAF2 | chr8: −: 120757276: 120757121 | NM_003184 | TAF2 RNA polymerase II, TATA box binding protein (TBP)-associated factor, 150 kDa |
| TAF2 | chr8: −: 120771346: 120771264 | NM_003184 | TAF2 RNA polymerase II, TATA box binding protein (TBP)-associated factor, 150 kDa |
| TARBP1 | chr1: −: 234571617: 234571386 | NM_005646 | TAR (HIV-1) RNA binding protein 1 |
| TASP1 | chr20: −: 13395909: 13395770 | NM_017714 | taspase, threonine aspartase, 1 |
| TBCA | chr5: −: 77070041: 77070009 | NM_004607 | tubulin folding cofactor A |
| TBL1XR1 | chr3: −: 176865407: 176865310 | NM_024665 | transducin (beta)-like 1 X-linked receptor 1 |
| TCF4 | chr18: −: 53202868: 53202790 | NM_001243226 | transcription factor 4 |

TABLE 24-continued

Gene Coordinates

| Gene | Coordinates (hg19) | Refseqid | Description |
|---|---|---|---|
| TEKT4P2 | chr21: −: 9963254: 9963195 | NR_038328 | tektin 4 pseudogene 2 |
| TET1 | chr10: +: 70440629: 70440724 | NM_030625 | tet methylcytosine dioxygenase 1 |
| TIAM1 | chr21: −: 32641011: 32640727 | NM_003253 | T-cell lymphoma invasion and metastasis I |
| TJAP1 | chr6: +: 43453391: 43453466 | NM_001146018 | tight junction associated protein 1 (peripheral) |
| TJP2 | chr9: +: 71792959: 71793045 | NM_004817 | tight junction protein 2 |
| TMEM214 | chr2: +: 27260130: 27260168 | NM_017727 | transmembrane protein 214 |
| TMX3 | chr18: −: 66368055: 66367951 | NM_019022 | thioredoxin-related transmembrane protein 3 |
| TNRC6A | chr16: +: 24769760: 24769920 | NM_014494 | trinucleotide repeat containing 6A |
| TRAF3 | chr14: +: 103356688: 103356763 | NM_145725 | TNF receptor-associated factor 3 |
| TRIM65 | chr17: −: 73887957: 73887894 | NM_173547 | tripartite motif containing 65 |
| TSPAN7 | chrX: +: 38425575: 38425608 | NM_004615 | tetraspanin 7 |
| TXNL4B | chr16: −: 72127025: 72126872 | NM_001142318 | thioredoxin-like 4B |
| UBE2D3 | chr4: −: 103774240: 103774195 | NM_181890 | ubiquitin-conjugating enzyme E2D 3 |
| UBE2L3 | chr22: +: 21933070: 21933127 | NR_028436 | ubiquitin-conjugating enzyme E2L 3 |
| UBN2 | chr7: +: 138949929: 138950208 | NM_173569 | ubinuclein 2 |
| UNC13B | chr9: +: 35291066: 35291101 | NM_006377 | unc-13 homolog B (*C. elegans*) |
| URGCP-MRPS24 | chr7: −: 43945050: 43944971 | NM_001204871 | URGCP-MRPS24 readthrough |
| UVRAG | chr11: +: 75603173: 75603437 | NM_003369 | UV radiation resistance associated |
| VDAC2 | chr10: +: 76990177: 76990208 | NM_001184783 | voltage-dependent anion channel 2 |
| WDR27 | chr6: −: 170061846: 170061799 | NM_182552 | WD repeat domain 27 |
| WDR90 | chr16: +: 702156: 702218 | NM_145294 | WD repeat domain 90 |
| WHSC2 | chr4: −: 1993796: 1993723 | NM_005663 | Wolf-Hirschhorn syndrome candidate 2 |
| WNK1 | chr12: +: 1004327: 1004362 | NM_001184985 | WNK lysine deficient protein kinase 1 |
| XRN2 | chr20: +: 21326472: 21326525 | NM_012255 | 5'-3' exoribonuclease 2 |
| ZFP82 | chr19: −: 36891305: 36891187 | NM_133466 | ZFP82 zinc finger protein |
| ZMIZ2 | chr7: +: 44790571: 44790690 | NM_031449 | zinc finger, MIZ-type containing 2 |
| ZNF138 | chr7: +: 64277652: 64277713 | NM_001160183 | zinc finger protein 138 |
| ZNF208 | chr19: −: 22168468: 22168407 | NM_007153 | zinc finger protein 208 |
| ZNF212 | chr7: +: 148945885: 148945948 | NM_012256 | zinc finger protein 212 |
| ZNF280D | chr15: −: 56935772: 56935673 | NM_001288588 | zinc finger protein 280D |
| ZNF350 | chr19: −: 52470649: 52470511 | NM_021632 | zinc finger protein 350 |
| ZNF37BP | chr10: −: 43046910: 43046848 | NR_026777 | zinc finger protein 37B, pseudogene |
| ZNF426 | chr19: −: 9645012: 9644915 | NM_024106 | zinc finger protein 426 |
| ZNF618 | chr9: +: 116797471: 116797515 | NM_133374 | zinc finger protein 618 |
| ZNF680 | chr7: −: 64002295: 64002108 | NM_178558 | zinc finger protein 680 |
| ZNF730 | chr19: +: 23321296: 23321357 | NM_001277403 | zinc finger protein 730 |
| ZNF777 | chr7: −: 149154134: 149153846 | NM_015694 | zinc finger protein 777 |
| ZNF804A | chr2: +: 185677213: 185677264 | NM_194250 | zinc finger protein 804A |

TABLE 24-continued

Gene Coordinates

| Gene | Coordinates (hg19) | Refseqid | Description |
|---|---|---|---|
| ZNF836 | chr19: −: 52668638: 52668509 | NM_001102657 | zinc finger protein 836 |
| ZSCAN25 | chr7: +: 99216410: 99216516 | NM_145115 | zinc finger and SCAN domain containing 25 |

The sequences for iExons produced in certain affected genes at the indicated coordinates from Table 24 are shown in Table 25. In certain instances, detection and analysis of the amount and type of iExon sequences are useful biomarkers produced as a result of contacting a cell with a compound as described herein or administering to a subject in need thereof a compound as described herein.

TABLE 25

Gene Sequence

| Gene | Sequence | SEQ ID NO: |
|---|---|---|
| ABHD10 | GACTCTGGAAGGAAAAACTATATTTCTTTACATTCAGCCTAAAATTGCATGA | 3808 |
| ADAL | GAGACTTACTGTATGGGTGGACATTATAGAGAAGGAAGAAGTTCAAGAAGAGCTTAGAG | 3809 |
| ADAM17 | CCTCTGGTAACCACCATTCTGCTGTCTACCTCCACGAGATCCACTTTTTTAGCTTCCACACATGA | 3810 |
| ADAM23 | TGAATATGGCCACAAGCAGGCTAATAGGGGCCGTGGCCGGCACCATTCTGGCCCTGGGGGTGATTTTTGGAGGCACAGGGTGGGGAATAGA | 3811 |
| ADAM23 | CCTGTTTTCTGAAGCGGACGAAGTGCAAATCATATCCAAAGCATAGA | 3812 |
| ADAMTS19 | TTCATAAATAAAGTGGATGGACAGAATTTCAAGGATCGCATCATTTCTGACTTCATATCATCGATTTTATAGCCAGAAAGAGCTTTCTAATCTTTCAGCATATTCATGAATTAAATGAGA | 3813 |
| ADAMTS19 | TTTCACCCACCAGTATGTAAGCTGCATGAGGGCAGAGTGAGTTTCTCCAGCATCTAGCCTAGGGACTGGCACAGA | 3814 |
| AGPAT4 | GATACTGCAGCCATCAGCAGACAATCAATGCAATCATCTCAGACTGTGTCCTGCGTCCCAGGA | 3815 |
| AGPS | GGCATTAATCTATTCATAAAGATATACGTCCATGACCCAACCACCTCCCACTAGGGGATCAAATTTCAACATGAGGTCTGGAGGGTTTGGTGTCCAAACTACAGGACTCCTTTAAGAGAGTGAAAGGATAAATCACAGA | 3816 |
| AKAP8L | GTGAAAACAGCTCCAGCGTGAGTTTTGGCACCACACTGGTAGAAAACACTTGGTGTTCAGACCCTTTTGGACCTGGGGGAATTGCAGA | 3817 |
| AKT1 | GTGGCCACTTCTTGACTGCTTTGAGTCCCTCATCCGAGCGAAGGGCGGACGGAGTCCGTTGGTGGGGTCCGGTTGCCTCTCCCGGGAGCTGTGTAGACTTCTCATACACCAGGGTTCTGGAGGCAGATGGAGGAGCCCTTTCGAAAACAGA | 3818 |
| ANKRD13C | GGAAACCAAGAATACCAACTCACTTTGCCTTGTCTGTGATGAGAACTGAAAAACCTACAGA | 3819 |
| ANXA11 | AGTATCTCCTGCATGCCAGCAAGCTATGGACATCTGGAAGAAGCCACATGCCTTGCCCTCAAGTTGCTTAGGGTGGAAGGAAATGATTAGAAATGAGCCAAGCCGAGCCTGCACTCTTAGA | 3820 |
| AXNA11 | CAAGCTATGGACATCTGGAAGAAGCCACATGCCTTGCCCTCAAGTTGCTTAGGGTGGAAGGAAATGATTAGAAATGAGCCAAGCCGAGCCTGCACTCTTAGA | 3821 |
| APIP | CTCTGAAATTAAATCCCTACTGACTGGCCCTTGAACTGATTTTTCTAACATCAGCAAAAGTCAAGGAGTGTTTCCCTAAAAAAGAAAGCATTTACTCAGAAACCGTATATTGAAGTCCAGGCTGAAAAATGCAAACATGA | 3822 |
| APPL2 | TAAAATGAAGTTAATGGAACCATGGAATCTACCTTGGAGAGTTGCTAGAAGAATTAAATGAAGTCACATATGTTTAGTGCCCAGCACAGCGTCCAGCACATAGGTGGTACAGA | 3823 |

TABLE 25-continued

Gene Sequence

| Gene | Sequence | SEQ ID NO: |
|---|---|---|
| ARHGAP1 | GGCCGTCAACCTTTCCACCTTGAAACTGGTGTCAGGAGCACCCTGCAGA | 3824 |
| ARHGAP5 | TTCTAGAGGCTGGTAAGTTCAGGGTCAAGGAGGCCTCATCAGGTGAGGGCCTTTTTGCAAAGTCATTCCATGACCGAAGGTGGAAGGGCAAGAGAGCACACTCAGAGA | 3825 |
| ARL15 | GGAAAAAAAATGCTCCTTTCATTCCAAGTTTGACTCCAGATTTTGCTGAATGGATTAGA | 3826 |
| ARL15 | GGGCCTTCCAGAGAACAAATGGCTGGTCCTTTTCCAAGGGGACAGATTTTCCTACCTGATGCTTTTGTTCTCCAGCAAGAAAAGAAAATGAAAACTGTTGTCTTCCCCTAGAATATTGAGTCCAGA | 3827 |
| ARL5B | GAAGCTTGAAAGAAATTTCACATTTTCTGCAAGGACTTAAACCTGAGCTCTCAGCTTTCTGCAAGA | 3828 |
| ARSJ | GTAATTAGCTGAGAAGGAAGATCTGAAGGTTTAACGAGAGAGGGCGAGAGATACAAAATATCTGCTAGGAGA | 3829 |
| ASAP1 | TCTAGGAGA | 3830 |
| ASAP1 | AGCAAACCCCATTGTCAGGGGAAAGCAGAACAAAGAAAAGTATTTAGAAATGTATTTCCGGGATGCACAGATTCTTTTCACCCTCACCTTCCCCTAGGTTGTTGCAGCTGCGCACCTGCTCTGTGAAGCACAGATTGTCATGGGGGCAGTTCTCTCAAAAACATGGCATATTGTGATGA | 3831 |
| ATF6 | GTTGTATGCTTTCTCTGTGCAGGGATAAAGTCTATTCATTGTGTTTTGTCTTTTACAAGATCTATTGCAATGCATTGCAGGCTCGGCAGA | 3832 |
| BECN1 | GATCCCATTGATGGATGGAAACTCTAGTTTTTACTTAGA | 3833 |
| BHMT2 | GATGTTTTCATCTGGCCCAAGAAGAACTTGTTCTTAATGTTAAAAGACCTTTTTGCTAAACTGGGAAGAAAGTGCTGGAATAACAAGA | 3834 |
| BIN3 | AGCTCTCAAAAGTACAGGAAAGAGATTGCTTCAGTGTGGTGAGAATTTGGCACACATCTGACCAATGGCTCCATCTCTAGCAAATCCAGA | 3835 |
| BCN2 | GAGTGCCCCAGATCTCCCTGTTTCACCTGTGATTATCTGTGATGCCATAGCAACACCCCTTGCTGTTAGCAGA | 3836 |
| BTBD10 | ATGAAAGAACTGAGCTTTGGAGGCTAAATTACTTGTCCCAAGTTAATACAGCTTAGAAAGTGATAGA | 3837 |
| C10orf76 | GCAATCTACACAGCTATTTCCTGTGGGAAATCTCCTTGAAGAGTCTGCCAGATTCCTCTTGGAACCCTCTCAGA | 3838 |
| C11orf30 | GCCTTGTTCAAAGCTCTGGGCATCTAGCAATGAGTAAGATAGTCAAGATCTGTGCTCTGTCCACGTTCTCTTGGAGCTTACATTTTAAGA | 3839 |
| C11orf73 | GTAATTATTGAACATCTACTTGCTGCCTACTTTCAACATCTGCATGTGTGTGTGAATATTAAATATCACACCAAGACATTGTTCAGAGGAGACAGAATAGTGAGCTGAGATAAATGAGAATCTCTCTATGGAAGATTAGACTGGAGCATGAACTTGAAATATGA | 3840 |
| C12orf4 | TGAGCACCATAAAATAAAAACGCCATACAATCCAACAATTATTTATTAGTTCTTGCCATTCGCAACATCCTGCCTAATACATGGAATACAAGACAGTATTCCTTCCACTTCAAGAAGACTGTTTTCTAGCCAAGA | 3841 |
| C1orf27 | CTATAGAAATGCAAATCAAAGGAGCATAAGCCAATAGAGGGAATGAATATACTGACTTCCATCCACAGACCAGAGGGAAAACAGA | 3842 |
| C1QTNF9B-AS1 | GTCCAAGCGGCTGCCCTGGGGCTTGACATTGAAGGCGGCGCCCACGGGAGACCAGCTGGTGCTGACCCTTCGGGCCCGGATCCCGGCTTCGAGGCTTCCCCGGCCCGCCCGGCGGGCGGCAGAGCTGCTGCTCTGGCTCCCAAGCCGCCCAGCCTTCCGACGCACAGCATTCTAGCACCAGAGCAGTCCCTTCCTCCAACGCAGATCCCTGCCCTGCTGCTTTCGCTGGGAGCCCGCGCTCCGCGTTTCCAAGGCAGCAGCCCACGCCGCCCACGTGACGGCCCCGCTTCCGGGTCTGGGCGCGGCCTCAGGACGTGGGCACGTTGTCGTCCAGAGAGCAAGAGCGTCGCTCCCCCTCGCCTTCTCGGCCGCCCTCCCGGTTTACCGCCCCCTGTGTCCAGA | 3843 |
| C2orf47 | TGCCAACATCCCCAGTGAAACTTTAAGAGGAGCCAGTGTATTCCAGGTTAAGTTGGGGAATCAGAATGTGGAAACTAAACAACTTCTTAGTGCAAGCTATGA | 3844 |

TABLE 25-continued

Gene Sequence

| Gene | Sequence | SEQ ID NO: |
|---|---|---|
| CACNB1 | TAGGAAACACCCCAATCCTGAGTCCCCCAAGCACATGCAGTGGTTC<br>CCCCTCCATGAAGA | 3845 |
| CACNB4 | GAACGGACAGAGTTTAAGATGGTGAAGGCCAATAAAAAAAGGAAAA<br>AAATGATGCAGACTCTCAAGAAAATGCTGTTTTCAGTCTCCATGTG<br>GAATTTCAGGATGTATTAGTACAGCCCGAGCTGGAAGGGTTGAAGC<br>AGAGA | 3846 |
| CADM2 | ATTAAAAAAATCAGCCGATGTGGTGGTGCATGCCTGTAGTCCCAGG<br>TAATTGGGAGGCTGAGGCAGGAGGATTGTTTGAGCCCAGGAGTTCA<br>AGTCTGCAGTGAGCTATGATCATGCCACAGTACTCCAGTCTGCGTG<br>ACAGA | 3847 |
| CCNL2 | GGTAGCCTCTGAGGGTAAGTGACTAAGACTTCTCCTCTGCTGTCCA<br>AGCGCTTTGGTGCAGGGACAGCGGCATCTTCAGCCAATCCAGTGCA<br>GGCTCTCCACCGAAGGCTGGCTCTAGACTGGTGGTACGCACATAGC<br>ATAGCCATGGCCGACTCCTGCTGTGGTTCTCTGACGATTGTGCTTC<br>TTGTTAATCCTCTGTCGTGCTTTGGTAATCGTATTGATTAGAGTTG<br>GTAACTGTCTTGACTTGAATTTTGTCCCTTTAAAACTGCTGTACCT<br>GTATGATAAAGATGCAGTACCTTTCTCTTAAAAAAAAATGCTATGG<br>AAAGCTGTGAGAATTGAAGAGACAAATTGGCTGTGTCAGTGTGGGG<br>TTATGTCATGATTTCTAGAAGCCCTGAAGTTGCTCTTTTGAGCAGC<br>TTTGCATGACACGCTCTGGTAAAAGGTGTGCATCTTTAAATTATTT<br>CATGGATACTTTGAAAAATATTGTATCACTTCAAATACAGCAATAA<br>GTTTATATGTTCTCAAGATTTCATTTGTTTTTAAGAATTTTAAGTT<br>CGTGGATTAATATCACTACTTGAATACTGACAGTTGTTGATTAGAC<br>ACCGAAAGGTTACTGATTGTTGAATGTATCTGTGTTAGAGCTGTGC<br>ACTGGCACGCTTGCATCAGGGGCTGGGGCCACACGGCCGCCACACA<br>GATTCCCCGTGATGCCTGGAGCTGCTTCCAGAGCCGGGTGTCTCC<br>AAGAGGCACCTGTAGGACTTCCCATTTAGAAATCTCTTGAGTGGGT<br>TTGTATGTTACCTTCTCCAAGGTTTATTTAGGACAGAGATATTGCT<br>GGAAGGTCATGGGTCAGATTCCCTCACAACCCACCTCGTCTGCGGG<br>TGCAGCCCCACTCCAAGGCTCCCCGTTATTGGGTATGTGAGGAGC<br>AGTAAATATAAAACCAGTTCAACTGTCCTCATGGAATCACCCTTTC<br>TGTTTTTGCAGTATTCATAAAGCTAGTGTAAGGTCTGGTTTTAGTC<br>TATTAAATCTTAGAGATCTAAAGGAAATGCTCAAAATGTAGCCAGG<br>TTTTAAATGCTTTAACTTTTAAAAAATGTAAATTTTTTGTATGTTTA<br>TAGCTTCTAAATATGAAAGTTAAAGAATGTACTGTGATGAAATGTT<br>CAGTATTATGTTGCTTCTCAGTATCATGTTGCTTCTCAGTATTGTG<br>TTGCTTCTGATTCTATGAATGTTCATTTTAAGACCCCTTGTTGAAA<br>TGGGACAGTTGGCAGCGGCTCTGATGAGCCCGAGAAGAGGCCTGCC<br>CTTGGGTGCGGAGTCTCCCTCCGCACGATGCTCCCACGCGTCCAAC<br>TTGCACCCAAGGGGCTTTTCCCTCTTCCAAGTGGACTCCTTCAAGG<br>AAGCTGCAGCTCGGTCAGCAGAGAAGGGGCCTGCCGCCAGCGCCCT<br>GGAGGAAGAGGAAGAGGAACCCAAGAGGATGGCTTGTCTCCCAGCA<br>GCCACACCGGCTTTGTGCTCAGCCAGTTCATTTGA | 3848 |
| CDH18 | TCAGGAAGTCTGAAGTCTAAAGGATATGAGCAGAAGTTAACCATGA<br>CAATAGA | 3849 |
| CENPI | GTTTTTGGGGAACAGGTGCTATTTGGTTACATGA | 3850 |
| CEP162 | ATAAATTGAAAAAATGGGAGGAAAGAGAAATGGAACACCTCAAGGT<br>GATACTGAAGTTTAGAGA | 3851 |
| CEP170 | GTGACAGCCTCTTCTTTTTATAAGCTCCTTTATCAGACGTAACCTC<br>CTCAAAAGCAAAGACTGTCATACAGATTTTGTAATCCCCTGCAGTG<br>GCTAGCCAAGTAGCCTGTGGAGA | 3852 |
| CEP192 | GAGAGTTCTTTGCTCAAAGATCTGAAGCTCTTGGTTGCCTTGGTGG<br>TGGTAACAATGTGAAAAGA | 3853 |
| CEP57 | ACCAGAGGCTGGGCTCTGGATTACAGCTCAGTAGTGGGTCATGGAA<br>TATGTACTGTGACTCAACCCGTATCATTTTCAAGAAAGAAGAGAGA<br>GAAAATCGTTCAGCAAATATAACTGAATGAATTATCTGGTTCACAG<br>A | 3854 |
| CHEK1 | GTTGAGGCCTTGGCTCCTGCCTGTAGTCCCAGCTACTTAGGAGGCT<br>GAGAGAGGAGGATCGCGTGAACCTGGAAGTTTGAGGCTGTAGTGAG<br>CTATGATTGCACCAGTCACTCCAGCTTGGATGACAGA | 3855 |
| CHRM2 | CCAGTCTCAGCAGAAGAGTAACATGACATGAGAGATTGGGAAACTG<br>TCCTTCTGTGGGGTTCTTCAGACAACCTAAGCCATCTCCTACATCC<br>TACACTCGCTGAACATAGAATGGTTGAAGGAAAGAATGAATACATA<br>TGTAGAAGAGAAGAATCTTGCTAAAAGGAATGAAGTTGTCAAGATA | 3856 |

TABLE 25-continued

Gene Sequence

| Gene | Sequence | SEQ ID NO: |
|---|---|---|
| | AATAATTAAGA | |
| CMAHP | AATGAACACTCCATGAGAGCAGGGACCTGCTTTGCCTTGTTCACCA CTTTATTCCCAGTGGCTAGAACCACGTCTGACACAGA | 3857 |
| CMSS1 | GTTTTTAAAACTCATTTGGACACCCACCTCAATATATGCTGTGCAA TTAGAATAATCCAGAAGACTGAAAGA | 3858 |
| CNOT7 | TTCTTCAAGAAACTTGGTTTTAGCATTGGAATACTGTGAGCATCAT TCATGTATCCTTTGGGAGACAGGAATTTATGATTTTCCCCCCTTT CTTGGTTATAGA | 3859 |
| CNRIP1 | TTAACCGGGTGTGGTGATACCACACCTGTAGTGCCAGCAACTTGGG AGGCTGAGGCAGGAGGATCACTTGGATCCAGGAGGTTGAGGCTGCA GTGAGCTATGATCACACCACTCACTCCAGCCTCGGTGACAAGA | 3860 |
| CNTN1 | GGTCTTTGTCACCCAGGCTGGAGTGCAGTGGAGCTATCACAGCCCA CTACAGCCTTGCCCTCCCTGGGATCAAGTGATCCTCCCAACTCAGT CGCCAGA | 3861 |
| COPS7B | TAGAGACGGGGTTTCACCTTGTTAGCCAGGATGGTCTCGATCTCCT GACCTCATGATCCACCCGCCTCGGCCTCCCAAAGTGCTGGGATTAC AGGCGTGAGCCACCGCGCCCGGCCCACGTTTGTGATTTAAACAACA ACAACAACAACAACCAGTTAACGTAATTGACAGCAGAGAAGTT CCAGGCAGAACAGTGGCTCTTTCGTTTTTCTTCTACACATGGCTTT TTGCCATCAGCATCAGTGAAGA | 3862 |
| CRISPLD2 | ATTGGGTCTTATCCCCAAGATATCTCATTATGTACATGCAAATCAG CGGAGCATCGTCATGACACCAGGAGGACACCCCGTGACGCCGATTA CCGCACTCTCAACCTCAACCCAGCGTCAGAGTTTTCTGGCATCTCT TCTTTGAGCCTGGCCGCCTGCAGCTGGAAATGCTCATATATGGTGG TGTGACTAACCTGAGAGAGAGATCAGGGATCCTGAGAAGTTCTGCA TTCTTGGTCTGCTTCCCAGTGGGACGA | 3863 |
| CRTBG3 | GGCCTTTCTGTCTGGTGTGTGCAGAATGATCTGGGTCACCTCTGAG GCCCATATTTATAGA | 3864 |
| CUX1 | CAGAGAAATCTCAGGAGGCACCATGCCAGGCCACTGTGCCCCTGCA AGTGTGTCTGAGTATGGCCCAGGACCCTGCCCATCACTGGTCTGCA ACAAGATAAGCACAGAAGTTCAGA | 3865 |
| DAAM1 | AGTCATGACACCCTGTTCAAACTCTCTGGACTTCAGCCAGTTGTTT GGCTAGATACAATTCTCAGAGAGGCAAAGGAACATTACAAAGGTAA TGGCATGAATACCATTACCTGTATGCATGCAACAGGAACCCTGCAC AGA | 3866 |
| DCAF17 | TTTTGCCAAGGAGTTTGTCCACAGAGCTCTTCATGCCCTCATGCTG GAAGTGGAAATCTGGACATGTTATCTTATCATGTCATTATCACACC TAGGAAAATGAGCAACAATTCTTCAGGATCATTTAATGTCAAGTTT ATAACTTCCTGCTTTAACTTAAAAAAAAAATTAAATTAGA | 3867 |
| DCAF17 | GTGGATCATATTGGATACCTGTGGTCATTAACAAACTACTATGTTA TGAAATTACAAAATGA | 3868 |
| DCUN1D4 | GCCGAAGATGGTGTTAGTGATTGCGAGCTGCTGGCTGGCACCCTTG CAGAGCAGGA | 3869 |
| DDX42 | GTGCAGTTTGAACAGGGCTTGACAGTGGCTGGACCATCACTAAGTG AGACTTTAATTCATCAAGCATAACTGAAAATGGAGGCAGTAGATTA TATCTTGGTAGCCAGCATGTGTAGACTTGTCTTATTTGGAGCCCAC TTGGAATTTTCATTTCAAGA | 3870 |
| DENND1A | CTGTGGCATAAGAATGAAAAGAAAAGAAACAAAAGCAGATGGCAGA GAAAACGAAAGGA | 3871 |
| DENND4A | GTCAAAGTCGTACTCTTTTGTTTGAGA | 3872 |
| DENND5A | GCCAAAATCATATTATATGATCAACCTCAAGTGCATGGGAAGCTGT GAAAGTGAACATTGAACTGGGTATAATGTTACCCTGAACAGTATGA AGGTCTATGAGCAAGAAAGAAGGGGTGAATGAATTATGA | 3873 |
| DENND5A | ATAGGACAGCATTTAAAAATCTCATGTGGAAGAATATACCACTAGA | 3874 |
| DET1 | GAGTGATGAATCTAAGCAGGAATGCCATCCACCTTCAGAGCCATTG GCGTGAGGATGACGGTGTGAAGTCTTTTCAAAGCAGGA | 3875 |

TABLE 25-continued

Gene Sequence

| Gene | Sequence | SEQ ID NO: |
|---|---|---|
| DET1 | TACATAATTTAGGATGAGAAGCACGAGTTACCGAATGAAGATCTGG TTGATCCCCCAGA | 3876 |
| DGKI | ATAAAATTCTGGAACAGACAATTATGTCCTTACAAACAACAACATT TGAGA | 3877 |
| DHFR | CCATGAATCACCCAGGCCATCTTAAACTATTTGTGACAAGGATCAT GCAAGACTTTGAAAGTGACACGTTTTTTCCAGAAATTGATTTGGAG AAATATAAACTTCTGCCAGA | 3878 |
| DHFR | GCATGTACTAACATAACATCATAACAGCCTCTTTAATGGAATGGAG GGAATTCTCTAACGGGAGACCTAGA | 3879 |
| DIAPH3 | GGTTTTGTTCCTAATGTCACATGTTTCCTAAGTAATTCAGCATAAA GA | 3880 |
| DIAPH3 | GTAAATTAGACCCAAAATAACTCCCAGGGAGCAATACACAGCCTGG AAAACATGAAACAAGGAGCGGCTGTTTGGTGTAATAAAGGAGGAGC ACCAGGCTGAATTTTCAGAGGCCTAATAGA | 3881 |
| DLG5 | GATGGAATGTCATCCCAGGAGCCATCTCTTTTCCTCGGAGGGCATC TCAAGACCCCCCAGA | 3882 |
| DMXL1 | GATAGGCAGTACTTTGTGAACCAGCTACAACAGAATCAGCTGCAGT GCTTGTTAAAAGTCTGGATTCTCAAGTTCACTCCAAACTTATTCAA TCAGTTTGTGAGA | 3883 |
| DNAJA4 | GGACACGGACATCTGCAACCTGACATCAGCTTGTACTCATATTCTG GGTTTTCGGTGACAAGTGACACACAGTTGATCATAAGTACCAATCA TAGACTGAAAATGCTCTGCATTTTAGAGACAGAAGTTAAAAGCTTT TCCATCCTGTTTACAGAAAGTTTGCTTTTTATCTCTAAAGAGGCTC ATGACCCACCTGAATAGGTGAATTGAAGGATGAGGCATTGCAAGGA AAGGCTGCTAACCCTCCCGTTCCTCCTTTCACTTCTTGCCATTTTC TTACAAAACTTTGGTTGTTCCGCATGGGTCTTGAGAGGTGGGGCCG TTATAGTAGCTGATAGCAGTGTCACTTGGGCCACGTTTGAAACCAC ACCAATCACCCATGTAGCATTTAAGACCTGTGGAAACGACGCTGGA ATCAAAATACCTGTCTGTGTTAGTTGTTCCAAGCTGGAGAAAGCTA CTTCAGGACGGTTGGCTGAATGGCAACAGTGATGGAATATTTATAT TTAGCCACATGTGCTGAATGTGGCTGTCACAAGTTTAAAATGCTTT CCTGTAAGACCATTTGTCTGTTACTCACTTGCGTTCTTTCTCATCT ATATTTAGATGGCTTACTGTAGCTTTTAAAGGCACTGGCGTTTTAC ATGGTGCTGGTGATTCATCCACCTGCTCCCTACATTCATTGTGGTC CGCTTCTGACAGTCTCCTTTAAGGAGAGCTTGTAGGCTTCTAATTT CACATTTCAGCAAGCTGGCTAAAGACATGTGGGAAAGCCTGACCCT GGATTCAGGTCAAAATCTCAGCACTCACAAGA | 3884 |
| DNMBP | CATTGGCCAGGACTACTAGAACTGTGTCAAAACAGCTGCTACACTA ACGGGCATCTTTGTCTTGTTCTCAGTCTTAAAAAGA | 3885 |
| DYRK1A | GTTCAGGGATGCTGGAAAGGACACTGAAGTAGGCCTTGGCTGATGG GCCTTTCAGAAGTGAACACTTAAGA | 3886 |
| DZIP1L | CAGCTGCTCTTCCAGCCCGGTCTCATCCCACAGTGGGCTCCTCCCC AGTCCCTCACTCTGCCATGGACCCTAACACAATATGTGTGTGGAGC GGACTCCCCCAAGGGTGGTACTGGAGTGGCCTCGCATAGCACATCA GA | 3887 |
| ELMO2 | GTATGCTCCTGAAGTGAGAAGCAGTGGTTCAAGGAAAGGCACCTGG GGAGTGCATGGCAGAGGACATCTTGAGGGATGGGGACCACCGGCAT CAAGA | 3888 |
| ENAH | AGTCTGACTGTTGCCCAGGCTGGAGTGCAATGGCACCAACATGGCT CACTGCAACCTTGACCTCCTGGGCTCAAGTGATCCTCCCGGCCTCC GTCTCCCGAATAGCGGTCTTACTCATTTTCTACGTGTGTGTTGAGT GCACCATTTGAGA | 3889 |
| ENAH | ACAGAGTCTGACTGTTGCCCAGGCTGGAGTGCAATGGCACCAACAT GGCTCACTGCAACCTTGACCTCCTGGGCTCAAGTGATCCTCCCGGC CTCCGTCTCCCGAATAGCGGTCTTACTCATTTTCTACGTGTGTGTT GAGTGCACCATTTGAGA | 3890 |
| ENOX1 | CTGCCTAATTGAAATATTCAGAGACAGAAGTTACTTACTCTCGTCT CACCTCCTACTTCTCTCAGAAAATGTAGTACGACTTCTAGA | 3891 |
| EP300 | GTGTTTGAAATGGCAGAAAATGAAACGGGTAAGGATGAACTCCTG TATAGATAGACTGGATAAAGAGAAAGCCAAGTGCATGATGTTCATA | 3892 |

TABLE 25-continued

Gene Sequence

| Gene | Sequence | SEQ ID NO: |
|---|---|---|
| | GAGGAGTCTTAAGA | |
| ERC1 | ACAGACCCTTCCAGAACCAGATGACCATCAAGACAAAAGCATACTC AAGCAGACAAGAAAGGA | 3893 |
| ERC2 | GCTGAAGCAGATTCAATATGGACTTGTTAAAACGTATGTTTTGTAA ATTGAGTTTATCTAAATCCCAGTCTAGAAGAAGGAAGCTCATTTTC TCTAGAAAGTGAATTTCAAAGTAAAACCACATGTTGGATGAAATAC AATAGA | 3894 |
| EVC | TTCCATACAACTATCCCGCTGATTCTTTCTTCAAAGAAGCAAACCC TCCTTTGCTTTTTATATTTTCTTCACACATGGAAATGGGGGATGTG GAGGGCCTTGCACAGA | 3895 |
| EXOC3 | GGGCCACCTCCATGGCTGCAGCCGCGTCACCTCCGTCCCATCATCT CGCTGGTTAAACGTGGAAAAACGGGGTCTTGAGCTCTCCACGGTCT CCCCTCTGGTTGGGCCGGAACAAAGATTTATAAAAGCAGTGTTGAA AAATCTTTCTGCAATTGGATTGAGAAAAGACAGA | 3896 |
| EXOC6B | GATATCTAGAGA | 3897 |
| FAM162A | GTTGGTTCATGTGATCCTGGTTAATGGAACATAAGTGAGATTTTAT GGGTGACAGGGAGAGAGATCAGGCTTGACTTGAGAGCACGTGGGAA AAGAAGGGGGCTATCTCTTCGCAAAGATTTAAGTATCTTATAAGAA CTGTTTGCCAGTGCAATTATGA | 3898 |
| FAM174A | ACTGCTGTGGAATTCCTGAGAAAGAGCAACTGAGGGATAGCAACAT GGATTTCACTGA | 3899 |
| FAM195B | GGTGTGGAGCGAGACCTGCGAGGCCAGGTGCCGGGTGGCGAGCGGG GCCTGGTGGAGGAGTATGTGGAGAAGGTCCCTAACCCCAGCCTGAA GA | 3900 |
| FAM208B | CATTTATGACATTAACAGAGAACAGGACTATGTCAAGAATTCTGAG GGTATACTTGGTGAAAATGAATTAAGACCACCCTCCCAGCTACATT CTCTCTTAGAGAAGATCGAGACAGGGTCCCTATCAGAAAAGA | 3901 |
| FAM49B | ATCACATGAGGGCCACCTGAGAGAAGTGAGACCACATGAGGGAAAA CCCAAAAGA | 3902 |
| FAM69B | GCACAGTGGCTCACACCTGTAATCCCAGCACTTTGGGAGGCCAAGG CAGGTAGATCACCTGAGGTCCGGAGTTCAAGACCAGCCTAGTCAAC ATGGTGAAACCCCGTCTCTACTAAAAATACAAAAATTAGCTGGTCG TGGTGGTGCATGCCTGTAGTCCCAGTTACTCGGGAGGCTGACGCAG GAGAATCACTTGAACCCGGGAGGCAGAGGTTGCAGTGAGCCGAGAT CGCGCCACTGCACTCCAGCCTGGGCTACAGA | 3903 |
| FBN2 | GATTAATTACCGTTAATGTCTTGGAGACTATAACGTACACTGCACG TTGTAATAACACAAAAGGACAAGCAAGATGTAAGA | 3904 |
| FBXL16 | AAATTAGCCAGGCCTGGTGGTGGGCACCTGTAGTCCCAGCTACTTG GGAGGACACTGAGGCAGGAGAATCGCTTGAACCCGGGAGGCGGGGG GTACAGTGAGCTGAGATCATGCCACTGCACTCCAGCCTGGGACCTG GGCAACAGA | 3905 |
| FGD4 | AAAAAGACAGTCTACAGCCATACCACCCGGAATGTGCTCAATCTCA TCTAATCTCAGAAAAAGACAAATTTCCACGAAGA | 3906 |
| FHOD3 | GACAAAAAGCAAAGAAGAAGACTGTGGTCTAGAAGCCGAAGGAAGA TGAGAAGGAAGAGTGTCCGAGGAGTCAGCCACAGCCAGAAAGGAGA | 3907 |
| GALC | GTTTTTGGAGAATAGGTGGTATTTGGTTACATGA | 3908 |
| GBP1 | GGATATGATTACATTTCCATCGTCAGTGATGGACTGAATCCTGCTT CTATGCAGCTAAGAAATGGAAGAGTTACAAACGGGTTCTTTTCATG GAAGGAAAGAACAGCAAATGAGAAGCAGA | 3909 |
| GLCE | GGCAGAGGTGGAGAGGGGTTAGATTATTTCATCTGCCCTACAGTTG GCATAATAAAGA | 3910 |
| GNG12 | AAGAGGCAGATAAAGAGCTAGAGAAAGACATTGAAAGTTGAAGGCA AGACCAGAGA | 3911 |
| GOLGB1 | AGGTGCCTGATGCTGTTAATTCCTGAGCCTTTTGAAGATTCTGCAG A | 3912 |

TABLE 25-continued

Gene Sequence

| Gene | Sequence | SEQ ID NO: |
|---|---|---|
| GTSF1 | CCACATTTTTTTTTCTTAAATATCACCTGGGAGTGTGTTGGAAAT GGACAATCTCAGCGCTCATCCCAGACCTACTGAATCAGAATCAGCA CTTTAACACAGTCCCTAAGTGATGTAACACCTGGAGA | 3913 |
| GXYLT1 | GGATTGTTTGTATTCCTGCCAATGATTTGTGAGACAGTCTGTTCCC CACATCCTCGTCAACAGA | 3914 |
| HDAC5 | GTCTGGGATGAGACCAGAGTCCTCTTCCCTATGAAGCTGCCACAGG CTGGGCTCTGGGGGGACACAGACGTGCCTGAGGGTGGCCCTGTATC ACCCGTGGAGA | 3915 |
| HDX | GAGCTCTGATTTGAGGTGACAATGATTTTGAACCTTAAATTCTTTG GAAAGACTCAGAATGAAGTCCATTGTGGAGGCTCAGA | 3916 |
| HMGXB4 | AATTTCCAGTCTAGTGACGTGATAATGCCATGGACTAATCATCCAG TGCTGAATGTCGGAGCACAGGGTCAGGGAAAGCTTGAAGAAGGAGA AGGTTTCAGTGGAAGTGGACGCATGGAGGCAGAGAGATGTTCAGGA AGCAGCAGA | 3917 |
| HOXB3 | CAAGAAAGTGCTCGGCTCGCGATCAGGCGCTTGTTTATTTGAACGT GGACATTCCCAGGATCCGAAAAGA | 3918 |
| HSD17B4 | CTTTCTGACATCTTAACGAGGCAATACAGAGAGACGAATTTTCATC AGTTTGTTCAGGGAGACACATATAACAAAAGA | 3919 |
| HTT | AGGCAAGCCCTGGTGCTGTGGGAGCCCCAAGGAAGAGCCTCTGGCC TGGTGGCCACGTAGCCCAGGAGAGATTTCTACAGGAGCCCACAGCG CTGAAGGAGAGAGAGGCAGCAGA | 3920 |
| IFT57 | ATCCATACATACTTAATGCTGAAATGTGAAGGGCTGAGAAAAAAGA AAAGA | 3921 |
| IKBKAP | TGGCTGAGTAATCTTCAGATCCCAGTACTTAGCAAGTGCTCAGTCG GTGTTGGATGTAGGCCACAAACCGGATCGTAAAGAATTCAACTGTA TATTGACAGCCACGGAACTAATCAATGAATAGATCCGTATGAAGA | 3922 |
| INO80 | GATTTTCCTTTTTCTCTTGAAATCGTATACCCTCTTCAAAGAGAGA AAGAAATGCTTCCAATAGA | 3923 |
| INPP4B | GTTGAGGCTGCACCTGGGAAAAAACACAAATTAGAGGAGCATCTGT GACCCCTGCCTTTTCCAAAGAGGGTTTTGAGGACTCCGATATGTAA AAGAGAAAGA | 3924 |
| INVS | AAATCCCATCCATAGTGTGGAACTGAAGTAGAGAAGGCAAAAGATG GATTCAATCAGTTGTTTGAAACAGGTCCCCCAAAGGCACACATCTT CGCAGA | 3925 |
| ITCH | GGTCTTCCTCTGTTGCCCAGGCTGGAGTACAGTGGTGTGATCATAG CTCACTGCAGACTTGACCTCCTGGTTGGGGAGTGGTGGTGTGCACC AGTGGTCCCAGCTACTCAGGAGGCTGAAGCAGAAGGACCCCCCCAG CCCGGGAGGCGCTCCAGAACACCCCAGCTTGGGTGACAGA | 3926 |
| IVD | GCCATCCAGTCTCCTGGCTTTACTGGGTGGAGAGGTGCTCAGCAGC TTCTGTCACTAGCTCTGAATGGCCTGTCTCCTGGACAAAGAAGCTT TCACGGACTACTCTGCAGGGAGGTGACATTGGACCAGAGCTGACTC CACCTGGGGGAAAGA | 3927 |
| KDM6A | GATATTTTCATTGTCTCCGAATTTTAGAGCTGAAAAGTGCCTTAGA GATCATCTAGTTCAACCTCTCCGTTCAAATGGAGAACCTGAGCCAC TAAGATTCACAGGAGA | 3928 |
| KDSR | GAATGAGTAAATAGGTTAAAGATATAACTTCAGGAATTTAGAATGG CAAGAAGTCTTCAGTGCCGGGCCTTGCAGATAGAGAAATAAAACAC CGTATCTGCTGTTGAGGTGTTAACCTGGATTTTCACCTAAGAACCA CTGCTCCAATGTGTTTTGAAAATGGAATACTCCTCTAGA | 3929 |
| KIAA1524 | GTCAGGAATTATGGTTAAAGGTGGATTTTCACTGATGGTAATAAGA TATTACTTTATACCCCTTCCCTCCTCATGAATTAAGTCCATCTAAT CTTTACTGAGGACCTGCTGAGTGGTAGACACTATGATTTGTTTCTG TTTCCACAGATGTCACAATTGTCAGTAATTGTGGACCTTTAGA | 3930 |
| KIAA1715 | TTCTCAGGTTTTCTTGACACCAAGAAAGAGAGGGAATCAAGAAGAT CGGTTGTAAGAGAGCAATTCAACATGAAAATACTGAAGAAGAGATG GGAGAGAGAGAGAGATAATTGTTTTCTTCAGAGTTTTCCACTTTCT ATCAGTAACTCTGATCACATGGATATCTATTGTGGGCTAGTTGAT GCATCCCTTCAGATGTGTTGGAAAGAGGACCAAGA | 3931 |

TABLE 25-continued

Gene Sequence

| Gene | Sequence | SEQ ID NO: |
|---|---|---|
| KIDINS220 | AAACACTTACCTATGTGAACATCTGAAATGTAACTGTGACCCAGAG CGTAAACAGAAAACTTCCCTGAGTCTTTGGAATTATAATTTTGAAA ACTGTGATGTAAAATTGATGTATTCTCAGGACTGTGGATTTAGA | 3932 |
| KIF21A | GCACGAGTATTCGATGTAATTTCGGCTGTTTTGATACTTATCAAGA AGGAAAGCTCTGATAGTTGCTCATGGAAAATTGCAACATCATCACA CTGTGTGAAAAATTAATGAAGCATTCATCCTAGA | 3933 |
| L3MBTL2 | CATTTTCCCATGGAAAGCAGGGTGCTTCTGTAGCTGGCCTGGGCCC CGTGGGCCCCGAGAGGCAGATGTGGATGCTCCTGGAGCCACTTCTG TAAAAGGCTCCTCGATGCGGATCATGTAAAAGCCAGAACGAAGGGC AAGGCCCTTAGGGGCGGGGCTTGAGCGCAAGAACCGAATATCCAGC AGCTGTGACGTGTGGAGCCTGCAGGCCGGGAGAGCAGAGCCCACAA CAGCACTCTTGTTTTGTCTTCACACCACGTCCCTAAGCTCCGGAA ATCCAGGAGGAGGCCTCTTTAGTCTTGAGGAAGTAGGGAGTCTTTT ACCCAGA | 3934 |
| LGALS3 | GAGCGGGGCGGCGGGCAGCGATCTGGGCCCGGGGCAGTCGCCTTTG ATTATCGAGGGCGCTGGCGTTCGGGGAAGGTTGGCAGCACCTTACG AGACCCACACACGTCCCCGGGGCGGCACGGGCCACCTTCTGCGGAG CCTCGTGGGCTTCGCCGCCGTCGCACCTCCGCCGCCTGCGCTCTGC GGCCCCAGA | 3935 |
| LINCR-0002 | AAGTGGGAACAGAGGCTATGGTAGTAGTTTACTTGTCCAAAGACTC AGAGCTAGTGACTGATGAAGTTGGGACTCAAATCCTACATTCTACC TCTTAAACCAGGAAACTTCCCTCTACACCCCACTGCTTCTGAAGA | 3936 |
| LINGO2 | GCTACCTTCTCCTGCCACAGATACTCTATCCCATTTGCTGTCATCC AACGACTAACACCGTTTTCACTTCAGAACGTCAAGCCTTTTCTGTT CTCTTCATGGCCTCCTCCCATTAAAGCTGAAAGTATCTGCTATCAG TCATTTGTCCTAACTGA | 3937 |
| LOC400927 | AATGTTAGAACGACTTTCCAAGTTTGAAGTTGGAGATGCTGAAAAT GTTGCTTCATATGA | 3938 |
| LPHN1 | GCACAGCTAGATGCGGTGGCTCATGCCTGTAATCCCAGCACTTCGG GAAGTCGAGACTACAATGAGCCATGATCACACCGCTGCTCTCCGTC CTGGGCAATAGA | 3939 |
| LRRC1 | GTTCTAATGGGAGAAGTGAGAGCAGAAAAGGGAAGCACAGGAACCT ACTGAGGAATCCACTTGCAAAGA | 3940 |
| LRRC42 | GTTGATGTCATATTTTTAGTCTTGAGAAACAGCATCATGCCAAGGA AAGAGCTTGAGCTTTGGAGTAATGCGGCCCTGAGATTGAATTCTGG CTCTGCCACTTATTAGCTCTGTTCTAGA | 3941 |
| LYRM1 | GTGAAGTAGTATTTGAAGCTTTTCATCAGTTGGCTCATTCTTTACT CAAGAATAAACCTCAAGAACGTCATCAGGGTCAGA | 3942 |
| MACROD2 | GTTTCCTTCCTTCGCTGCCGCAGCGTGACTTTTGAAACCTGGAACT CTAGGGGAGCCCTAAAACGAGCGTGTTGTCCGTGAGGATAAGTGCC TTCAGAGAAGTCTGAATGGGCTGTTCTCCCAACAGTGTGTTTCTCT GTATTCCATCCCCATTCATGGGCTGAAGTTGCTCAGA | 3943 |
| MANEA | AATACCTATCCAAATGTTTTCCTTCTGAAGTATTATGTTCTACTTT TAGAAAACAGA | 3944 |
| MAPK10 | ACCTTAATTCTATGAGAGTAGGGGCTGTGACTCATTTATCTGACTA AATCATGGCCTAACGATGCCTCAGACAGA | 3945 |
| MARCH7 | AATTGGAAACATCGAGGGAAAATGGGCTTTTTATTATTAAAACAAA ACCTCAGTATTATCACTTAGAAACCTGAAATTGAACTCCAAAAGCC AAAGA | 3946 |
| MARCH8 | TAAATGAAAAAGAAAGTCTGGCTATTTGGAGTAAATTAATGAGCTC CTAGAGGAGATGGGACTAGCAGAGTCTGCTTGTACCAGGAACTCTT AGCGTCGATTTCGAGCTGTTGCTGCCAAAGTAGCAAGGACCAAAGA | 3947 |
| MDN1 | ATATGATAGCAGCCTTGGTGAGCAGACCACGACCATGGGGTTTACC CAGTGGGATCCCGTCACGGCTTCTTCCCTGCCTGTGTCTCTCCCCG ACCCCTGATTCCGGCCATGAAGTCTTAAGAGCCAAGTGCTGTGTGC GGCTGCCCAGCACAAACCGTCTCACTCTTTTCATTGTCCATAGGCT TTTGCTTTTTTAAGA | 3948 |
| MEAF6 | GGTCAAACAACTGTTCTGCCGAGA | 3949 |

TABLE 25-continued

Gene Sequence

| Gene | Sequence | SEQ ID NO: |
|---|---|---|
| MEMO1 | AAAGCGTGCTCTGGAATGGATTCACAAATGAGCTACCCTCCTTCCC TCAAAGA | 3950 |
| MFN2 | GGCACTTCCTCACATGCCAGCGCAACTCCCCAATACCTCAATGA | 3951 |
| MLLT10 | GAACCCTCCCTCAAGCATGGTGTTAGACTGGGTGACAATGGAGA | 3952 |
| MMS19 | CATTAATTTACAGAAATACACGTATTCTCCTTGTTTTGGTGGAAGC TGCAGCTGCCAATCATCTCTCAAACCCTGTGGGTAGCTGCTAAGCT GTATTTCAGAGGAATGTCACAATCATACCACTGGGGAGAAAGA | 3953 |
| MORF4L1 | AGGCTGAACACTTTAGAACTACTACCAGAAAGA | 3954 |
| MRPL39 | TCATTCTTCACTACCTCGCCTGAGTCGTACCTCCTCCATGGAACAG TCTCAGA | 3955 |
| MRPL45 | GTCTGGGTGGTGGCTCATACCCGTAATCCAGCACTTTTGGAGGCCG AAGTGGGAGGATTGTTTCTGGGCAGCAGA | 3956 |
| MRPS28 | ATGGGACCTGCAAAGGATAAACTGGTCATTGGACGGATCTTTCATA TTGTGGAGAATGATCTGTACATAGATTTTGGTGGAAAGTTTCATTG TGTATGTAGAAGACCAGAAGTGGATGGAGA | 3957 |
| MTMR3 | AGGCGTGTGTGTATGTGTGTGTGTTTCTTTTCCTGAACAGATTGAG A | 3958 |
| MYB | ATAGGACCTCTTCTGACATCCCCAGGAATATTATATGATTAGAAGC CAAGGGATGA | 3959 |
| MYCBP2 | GTGACCAACTGAGTGCCATATTGAATTCCATTCAGTCACGACCCAA TCTCCCAGCTCCTTCCATCTTTGATCAAGCTGCAAAACCTCCCTCT TCCCTAGTACACAGCCCATTTGTGTTCGGACAGCCCCTTTCCTTCC AGCAGCCTCAGCTTCAGA | 3960 |
| MYCBP2 | GCATCTAGCATAGAACTCCCTATTCTGCATTATGACTACTGGACCA CTTATCTCTCTGCCCTACTTGATAAGTTCCATGAGGACAAAGA | 3961 |
| MYLK | CTTGCTGCTACTTGCCAGGCCTTAAGTGGAAGAATGGAGTGTTGAT TGTGTCAGTCAAGA | 3962 |
| MZT1 | GATCCCATTTGAACAGAAAACTCACATTTTCTCTGGTGGAATCACT GATGTACAATTGAGAACTGATGGTTTGTGTTGGCTGCATCATCAAG ATCTCTTCTGAGAAAACTTGGTGTGAAATGAAGATTATAAAGAGA | 3963 |
| NEDD4 | ATTTACTTTATCACATACCTATCTGTCTATCCATCAGTCTGTCTTA GTTTCTTCATGCATTTCAGA | 3964 |
| NFASC | GTGGAAGTGGAATACTGGAAGAACCCAGCAGATCAACTCTGAGCTG CCCTTTGCCCTTTCAGAAAGTATCTCATTCCAAACAGTTCTTCGAA ACTAACCTCTTGCCCTCCAGCTACAGA | 3965 |
| NGF | GTTGGTAGAGGTGCAGCAATTTTTGCAGTGAAACTGAAGTCCAGCT GCTCAAACAGAAATGGCCTCATCTAATGGACACTTTAATGA | 3966 |
| NIPA1 | GTATTAAAGGAAGTAATCCGGTCCATACCTGAGCCTGGTATGCCCT CCTCCCGGACGTTCCTGTTTTCTGATCGTCTTCAGCACAGACATGA | 3967 |
| NLGN1 | TGACTGCTCATGAAAGAAATTAAAATGATACATCATCAGTGGATCT TCCTGTAGA | 3968 |
| NLN | CTCACTGCTTAGAATCTAAGGAGACAAGACCATAATAAAGGACAGT GTAGAAGACCTGAAGTTTTAAGCTCCAAATCTCTTAGCTACCAAAA TAAATAAATACTACAGAGCTGTTTGTGAGCAAGAGAAAACATCTAG ACAGA | 3969 |
| NREP | TGTTCCAGGGCGCCATTAACGATTGGAGTTGGCACAAAATTTGAAA CTAGAAGTGGACTATTTGCTCCTTGAGA | 3970 |
| NSUN4 | GGGCTCAGGAGTCCAGCGGTCCTAAGTATACCTTGCAGCCATCTTC CTAAAAGTTCTGACCATGACTGAGGACACTGAGAAGGA | 3971 |
| NUPL1 | ATGAAAACTACTCCAATCAACTTCTTCAATCTGTTCTGCCACATTT TAGCCAGA | 3972 |
| OSBPL3 | TGATGACAAATAAATGGTTCCAGCCTAAACTGACAGCCAGATACCA | 3973 |

TABLE 25-continued

Gene Sequence

| Gene | Sequence | SEQ ID NO: |
|---|---|---|
| | TTGTCCAGCTTTTTGTCTCATGGAAGCCGCACGCTTCAAATATGCA CCAGGTGCATTTCTGTTGCTGGATTGGGCTCTGAGCAATCTGATGT CCCCTGAAGAAGTGGATTGTGAAGGCCATGGATGGAGCAGGGAATA GAAATGGATACTCTATTGTGCCAGA | |
| PAPD4 | AGCTCTACCTCTGTTTTGAAATGTCATTAGTTTGGATATGTTACCA GGATGCAGCAAAGAAGA | 3974 |
| PBX3 | TGTTTTGAAATGCTTCAGAGAATGTGCGATATCCTTATCAACATGA TAAAATATGAAACTGTGATTGCCTGCAGCATTTTACAGACATGAAT TCCATCTTCACTGATGAGGCTTGATAAGGCGCTGTTGTATAATACA GTGCATAATCTCAAACCACCAGA | 3975 |
| PCDH10 | TGAACAAGTTACCAGATCCTTCTCCTCTGAACTCGGGTTGCAAAAA AAGCCTTCAGTTCGGCTCTGGACAGCATTTACAGACGCTCTTGAAG CCGAGCGCCCACAGTGTGAATTTGAATGAAGCTGCGTTGGCACAAA CCCCTGTTAAGA | 3976 |
| PDE3A | CTACATCATCTTTTCTAATTAAGAGAAAGAGAGAAAACCAGCGTGC AACTTAAAGACAGCTAAGGTTATCTTCTGAAAGATGCGGGTTCTTA CTAGA | 3977 |
| PDE7A | CATGAAGGAATGGCCACAGGACAGGTGACTAGTCATTGTGGGATGG AATTATAGTCGATGAAGTGAGCCTTGGAGGAAGTCATGGTCCTACT CAGAGAAACAGA | 3978 |
| PDXDC1 | TCTTCAAGGAAAACTATTTGATTTTCACATCTATGATGAGAGAAAA CAGAAAAATTGTCAAGA | 3979 |
| PDCDC2P | TCTTCAAGGAAAACTATTTGATTTTCACATCTATGATGAGAGAAAA CAGAAAAATTGTCAAGA | 3979 |
| PELI1 | ATTATCAAATACAGAAGTAGAAGCCAAGATTGAATGTGTTCCTGTG ATTGAAACTTTGATGTCACTGATAAAATATCCCCAGATAAGGCCTT CTAAGAGATCTAAGCAGA | 3980 |
| PIGN | GGGCATACTGCAACTGTCAGTGCATACTTTACGGTGGGAAAACTTG GAGAAGGAATGGGTTAGGAAAAAATCAGTTTCTGAGGA | 3981 |
| PITPNB | TGAGCTTGGAGTGAAGTCTAGTACGTCTGTGCAGCAAAGAGACCAG A | 3982 |
| PITPNB | GCGAAAATGGGCAGTGTTTACAGGCATGAATGCTGGTGGAAAGAGC AGAGTAAGGGCAGATTGCACAAGAACCGTGGAGGCCCTGGTTCCCA TCACCTCCACCTCAGCACAGACTTCAGAGAGGAGAGGAGGCACTGG ATGCATGACAGCAGCACTTGAGATAGGTGCTCCAGGTGGAAGGCAC TGCACATGCAAAGGCTGA | 3983 |
| PMS1 | GGATTCCCCCAGCAGACGTTTTTCATCTAAGAAATGGCTTGAGTGC TTCCTTTTATCGGGTGCTGTGATAGATTCTCAAAATATGAAAATGA | 3984 |
| PNISR | ATTTTGCATTTGTTGGATTTGTTAGTAGTGAAGATACTATGGTGAA GATGAAGGAAGAAAGA | 3985 |
| POMT2 | ATGTCCACTTAAAAAAATCTGGCGATGGGAGCAGAAAGA | 3986 |
| PPARG | ATGGTGACTGATGCATCTCTAACACACCACATCACAGACTTCCTGA TCATCAGAAGA | 3987 |
| PPFIBP1 | CCCTGTAATCTCTTCAAGAGATGATGATCTTTGATGGCATTTTGGG GGTGATGTTCAGGTGGCAGCCAGATTGGAGGGGACCGTGGAGCAGA CTGTGTGACTACTCATTCCAAGGGCATCATTGTGGAGA | 3988 |
| PRPF31 | GACCGAACTCAGAGGCCACCTCATCCTATTAAACCTGTTCTGGTTC CTGACATCCCCCGACCCACACGA | 3989 |
| PSMA4 | CAGAGAGACGCAACATCCACAAGCTTCTTGATGAAGTCTTTTTTTC TGAAAAAATTTATAAACTCAATGA | 3990 |
| PXK | CTGTAAAGTTTGACTGAGAAATGTTGCATCAGCCCTGAAGTTTATT GAGAAAATCTTACGCTGATGCAAACTTTTTGGACTGTTAGTGTCTT ATGA | 3991 |
| RAB23 | AGTGCTGGAATATGAATGAGCCAAATTGTGCTGTTCCATTGACACT GGTTGCTACAGAATTAACTTTACTCGGAGATCCGAGGAGCCATCGG CAGTTCCCAGGAGTAAGAACCTGAGAGCGTGTGAGA | 3992 |

TABLE 25-continued

Gene Sequence

| Gene | Sequence | SEQ ID NO: |
|---|---|---|
| RAB23 | AGTGCTGGAATATGAATGAGCCAAATTGTGCTGTTCCATTGACACT GGTTGCTACAGAATTAACTTTACTCGGAGATCCGAGGAGCCATCGG CAGTTCCCAGGA | 3993 |
| RAF1 | AATAACAACCTGAGTGCTTCTCCCAGGGCGTGGTCCAGACGATTTT GTTTGAGGGGAAGA | 3994 |
| RAPGEF1 | AGTGAAAACGCCAGTGAGGAAGCTGGTGAGGGTGAATATGTCAATC TGTATTCCTCTGGCCAGAGCAGCGAGGAGCTGGCTCCCTCTCGAGG A | 3995 |
| RASIP1 | CCGAGCGTGGTGACGCATGCCTGTAATCCCAGCTACTCGGGAGGCC GAGACATGAGAATAATTTGAACCCAGGAGGCAGAGGCTGCAGTGAG CCAAGATCGCGCCACTGAACTCCAGCCTGGGGGACAGAGCGAGACT TCGTCTCGAAAAAACAAACAAACAAACAAAAAACTGTCCTCC AGAAAAGAAAAAGGAATTGGAGACCTAGGAGCCGGAAGA | 3996 |
| RBBP8 | GACCATCTTAAGCAAGTCTCTTCTCCTGTGCTACTTGACGACTCTT TTGATACATGAAGACAGCTATCATGGCCCTCCTGAGTCTTGTTTTC TCTAGA | 3997 |
| RCOR3 | GTTAACTACTGTGAGATAGTGGGGCCCCAATGAAACATATAAGCAT ACCTTTTAAAATGTTGCCAAATAGTCTTCAGAGAACATACTTAATA CAAAAATGCTGTGCAGACATCATTCCGATTGATCGACTGATGGATG ACTCCGCAGTTTGGATTAGAGAGA | 3998 |
| RERE | CTGAAAAGGAGATGAAGATCCTGCTTGTAGCTGAGCAGTCTTTAGA AGTCTGCTGCATTCTTCCCAAATTCCATCACTCTAGTCAAGA | 3999 |
| RGL1 | GGTGAGGAGCAATCTGTGGGAAGTCAGTGCACAGTAGAGTTCAGTC TTCCAACGCTGAAAATTTGCCAACTTTCACCCACACTGTGGAGATG AGAAAGCAGCTGTGGGCAGACAGTAGA | 4000 |
| RNF130 | AATGGTTTATTATTGCCAGTTTTGGCCTCCTCAGTGCCCTCACACT CTGCTACATGATCATCAGAGCCACAGCTAGCTTGAATGCTAATGA | 4001 |
| RNF144A | GAAGACTTTGCCAGTCTCTGGTCCACACTGTTACTGGACTTCAGGA TAGCACATTGTTCACCACAGAAGGAAAGATGTGGAAATTAAGA | 4002 |
| RNF213 | AACGTGTCCCTAGTGCTAAGTGGCGCGGGACTCTGCTTTGCCTGCT GTCCTGCGGAGGCAGGAGGTGACCAGGAGAGTGA | 4003 |
| RPF2 | GGTACAGGATACAGTTTGACTACTTAAAGTTTGAAGAAAAAAGAAG AGTAAGAAAGA | 4004 |
| RPS10 | GTCCTCATAGCACACGATTGCTCTCAGATAATGTCATTTGTAAAAA GGAAGCATGTACAGTAGAAACGGTCCAATCCTGGTGCTGGATGCTT TCATAGGA | 4005 |
| SAMD4A | AACTCCAGGTTGACCATGGCAGAAAGGGCTCAGATTCCCCTTCCAG TGCTTCTTGCCAAAATCTGGGAAATAGGAACCAGA | 4006 |
| SCO1 | AGAAAGGATTTGAACTTGGCCTTCATGTATCAACTAAGTTAATCGA GCCTTGAATTGAGA | 4007 |
| SENP6 | GCATTCTGTTCAGGCAGCAATTTGGAAATCCACCATTTATCATGA | 4008 |
| SF3B3 | ATTTAACATTTTTGAGTCAATCCAAGTAATGCAGGAGGTTCATGAT TGTGTAGA | 4009 |
| SGIP1 | TAGAAACAGGGTTTCGTCGTGTTGGCGAGGCTGGTCTTGAGCTCCT GACCTCAGGTGATCCACCCACCTTGGCCTCCCAAAGTGCTGAGATT ACAAGCATGAGACACTGTGCCAGGCCAAGAGCTTTGGAGTTTTCTA AGGAATCCAGTGAATACCAAGTTCCATGCTTATGAAAGA | 4010 |
| SGMS1 | GCTCTTCTGGAACCCTGGACTCAAGTGATCCTCCTGCCTCAGCCTC CTGAGTAGCTGGAACTATAGGCACAAGCCACAGCACCGCCTTCAGT CTTTGCTTTGAGTAGA | 4011 |
| SGPL1 | GCCTTTGAGCCCTACTTAGAGATTTTGGAAGTATACTCCACAAAAG CCAAGAATTATGTAAATGGACATTGCACCAAGTATGAGCCCTGGCA GCTAATTGCATGGAGTGTCGTGTGGACCCTGCTGATAGTCTGGGGA TATGAGTTTGTCTTCCAGCCAGAGA | 4012 |
| SH2B3 | GTGGATTCCTAGAAGTGGCATTGCTCAGTCATAGA | 4013 |

TABLE 25-continued

Gene Sequence

| Gene | Sequence | SEQ ID NO: |
|---|---|---|
| SKP1 | GGACAACTGCATTATTGGCAAGCGCTAAGCAACATGGAGAAGCAGACATGTTTGTGAATCGCAAAGTGAAATCTGATTCTCTCCAACTATGGATGAGTGAGA | 4014 |
| SLC12A2 | TCAGCATTTTGTAGTTTTCAGCATATACGTCCTGTATGTATTTTGTTAGATTTACGA | 4015 |
| SLC25A16 | CCAGGCTTGGTGGTCCCAGCTACTTGAGAAGCTGAGTTAAGAGGATTGCCTGAGCCTAGGAGGTTGAGGCTTCAGCGAGCTGTGATCATGCCACTCTACTCCAGCCTGAATGACAGA | 4016 |
| SLC25A17 | ATTTGTTCAAGTTGAAATTGTAAACCTATGCCAGAACTTGCATGAAGAGATGA | 4017 |
| SMOX | CTGGGAAGACTGAGGCACAGTCATACAGCTAAATAGTGACAGAATGAGGATTGAATCCAAACATTTTACAGACGGGAGGACTGAGTCATAGTCATACAACTAAATAATAACAGA | 4018 |
| SNAP23 | TATTGGAATATGACAGGGAAGATGAATTCACTATGA | 4019 |
| SNX24 | AAGAATGTTCCTTTTGTGAAGAATGACTTAAGGAAGATTCATGATGACTGAGTGTGCCCGTGTGGAACTTTAGGACATAGATGCACTCCTACAGA | 4020 |
| SNX7 | AGTTTGCAAAGGAAGGAAAGGAGCAGAGACTTGAATGAGCAGAAAATCATTTCAGGGCCTGTTCTCTATGTCCTTGCTATCCCTGTCTTCTGTAGCTATTCTGAAACCATCAACAAAGGAGCACACCATTCCATCAGCAAAAGA | 4021 |
| SOCS6 | AATCCACAAAAATTAGCCGGGTGTGGTGGCACACACCTGTAATGCCAGCTACTCGGGAGGCTGAGGCAGGAGAATCGCTTGAACCCGGGAGTCAGAGGTTGCAGTGAGCTGAGATGGCACCACCACACTCCAGCCTGGGCGACAGA | 4022 |
| SOGA2 | TTCAGCAGTGCAGAGAGAAGCCGTGAGGAGTTCCGGTGTGAAGAGAAAGAATCTGAAAATGGAATGCTCTTCCTCCCTCCCCTAAGTGGAAAATGTGAGGGGAACTTTTTAGA | 4023 |
| SORCS1 | ATATCGCAGCACATTGCAAAGTCTCTGACACCTTTCCCTTTCCAGTGTCATTAAATGA | 4024 |
| SPIDR | GTATTCAGTAGAAGCAGATGAACAGCCAGATGAAGAGATGGATAGAGCAAGACATGGACATTATAAAGGAATTCAATAGAAGCACATGAACGGCCAGATGAAGAGATGGATAGA | 4025 |
| SPRYD7 | GTGTGGTTGTACGTGCCTGTAGTCCCAGCTACTTGAGAGGCTGAGCTGAGAGGATCTCTTGAGCCGGGGAGGTCAAGTCTCCTGTGAGCAGTGATCATCGTGCCGCTGCACTCCAGCCTTGGCACCAGA | 4026 |
| SREK1 | GGTGGCTGCACTCAACGAGTTTATGCAATGACTTTCTTGGATGTTTCTGAAGGAGGAGGATGTACAGAGA | 4027 |
| SSBP1 | GAGGCGGATCTTGGTCAGTAATGCTTGCTCGCTGCTTGCTGCTCACCTCCTGCTGTGCAGCCAGGTTCCTAACAGGCCACAGAACTCTACTAGTCCTCAGCCCTGGAGGTTGGGGACTCTCCTCTAACTGGCTGTTCGTTATGCCTGAGA | 4028 |
| STRADB | AACTAGGCTTGGAAGAAGCCAAGAGAAGCTGCATGACAAGGACCAGGACTGTGGAATAGGAGCAGCCTAGTGAATGTACTGCCCGCCACCAGACGCTGGCCCCTGCTGATAGCTCTGACGACTGCTGCTGCTTTGTCCTTCACTCCGTACTCCAGTTGGCCAAGCATAGGTCGCATGCCAGGGTCAAGGAGACTAAGGGAGA | 4029 |
| STXBP4 | GTTTAACCATGGTTGGAAATGACAGA | 4030 |
| STXBP6 | AATGTAAGCTCCATGAGGGAAAGTACTTTGTTGCTCTTCTTCTCCTCAGTATCCTCAGCGTTAGGACAATGCAGTGATATTGAATGA | 4031 |
| STXBP6 | GTGGTCCCTGAGTTAAGAACATGCAATGGCACTCTCTCAAGGAGAGGAAGGAGCCAAAGAAGAAAGAGGTCCAAAGCAGAAAAGAGCAGACAGCTAAGA | 4032 |
| SUPT20H | TTGAAGACGATAATTCTAACTTCCTGTCAGTTGAAGACGATAATTCTAACTTCCTGTCAGTTGAAGACGATAATTCTAACTTCACACTTAATTAAAGA | 4033 |

TABLE 25-continued

Gene Sequence

| Gene | Sequence | SEQ ID NO: |
|---|---|---|
| TAF2 | GAAGATGATCACCTTGCCAAGGAAGCATCATGTAATATATCAGCTC ATCAGCAGGGAGTGAAGAGGAAGTCTGATACACCACTGGGGTCCCC ACTAGAACCTGGTCAAATACTGGAGAAGAATGAGGATAGCAGTAAA GTCAAACTCAAAATCAGA | 4034 |
| TAF2 | TTTTGAGATCCACCAAATATGTCATTGTTGCCAGTCTTCTTTCCCA AGATGTATGGATAGTTTTTAATGTCTCATAAATATGA | 4035 |
| TARBP1 | CCGATTTCAGCCTACCAATGTGAGGCCACTGAGTTGGAAAGAGATA TGATCTTCGGTCTTTGCGATGCTGGCTGGGTCTGCTGCTACGCCGC TGCCTGTCTTAGTTCACAGAGGAAATAGTGGCTGTCAGGCTGGAAT GCTCTCAATTTCCAGTTGCCAGATGTATGGACTTACGCTATATGCT CAACCACACCTGAATTCATCCTCCCTGTCTTCCCTTTGTTACAAGA GA | 4036 |
| TASP1 | CTTTGGACCTTCCTCTCCCTCTGGTTTCCTGACTTCTATAAAAGAA TAGTTGAACTAACTAGTGGCATACCTGTTCAGCATCATGACTGGTT TCCGAAACATGTTCCTCCATAATGTTGAGAGCCGTGGTAGCGAAAT GA | 4037 |
| TBCA | ATCCCGCTATCTGTCCTGTGATGCCATACTAGA | 4038 |
| TBL1XR1 | ATTCCAGAATGAAGAAGATGCCTGTAGCCAACCTGTAGCTGACAAC AAAAATGAGAAATACATTTTGCGCTGTCTGTTGAACCCAAGACCCT TTCAGA | 4039 |
| TCF4 | GATTTGCCTCCAAGAAAAAATATATTTTATTGCCACATTTTCTCAA TTGATCCAGTAGAGTTCACAGACAATGAAAAGA | 4040 |
| TEKT4P2 | TTGAAGAGATACCATTTGACATTTTAGAGATGGCTGCATGCAAACT CTTAAAACATTTGA | 4041 |
| TET1 | AGATCATGCGTAATATTCCTGTTTCATGGGCCATAAGGACATGTGT TTAATTCATAAGGACATATGGATTCCATTTGAAACAGGATCTCACA CAGA | 4042 |
| TIAM1 | ATACCAGAGAAGCGTGAACATATTGCTTTGAAATCTACTTGCTCCT AGTAAAAAAGAGATTGTCTTTATTGGAAAATTCCCTCTGAGATTCC TGTGATGTGTGACCTGGTGGGGAATATTCCAGCCTGGGAACAGCTT AACATCTGGTGTCTGTATGAGTTACCCCTGAACTCACTGGAACATT CAATGGAGGGTTTCCCTTTGTGTTGCCACAAATTTTATTTCAGTGA AGATGTGCTGGTGAGAGTTTCAGCAACGTTTTAGCCTGAACAGTGG AATTATAGA | 4043 |
| TJAP1 | GAGTAAGATCTTCTGTCTCTGAAGCTTCTTAGGGGCAAGCTTTTTT ACTGAAGGCCAAGCATTTAGGCACTATAGA | 4044 |
| TJP2 | GGATTGGTGTCTCTATCATCCAGCTGGCCATTAAACAACCAAAGCT TCATCATCCTAGATAACCTGTGAGCTCTCAGAGGAGACAGA | 4045 |
| TMEM214 | CCATCCTAGATCTGAGATTTGCAACCTGGAAGTTCAAGA | 4046 |
| TMX3 | GGAAGGTAATGAGAATTATAGTACTTTAATTTTCCAAGCTCTTGAC CATGAATGTGTAGATTATTTTTCAGAAGGCGTAGATACAATGCAGT TATCAAATGCAGA | 4047 |
| TNRC6A | GATGGGAGAGAGAAGAGCATGAAAGAAGCGGTTGGGATTAGCCTTC TTCAGTAACATACCCTGGGGTCGTCCTTTGGAATTTCATGGTTATT GTGGTGTATGTGACCACATTTAGAGTGCACTGCCTCAGACCTGCCT TAAAGCTGTGTCATAGGATAAGA | 4048 |
| TRAF3 | CACCAATACATTATTATGAAGTCAGTACAGAGAGATTGGCATCTTA GTATTTTCTGAGGAAGAGAACAGCCAAAGA | 4049 |
| TRIM65 | GCCCCAGGTCCCCTGGCACCGGTCCCAAGCACAGTTTGTCCACTGA GGAGGAAACTCTGGCAGA | 4050 |
| TSPAN7 | GTCTATAGAAGAGGAGGGAAAAACACACCTAGGA | 4051 |
| TXNL4B | TTGTGGCGCGCGCCTGAGGTTCCAGCTACTCGGGAGGCTGAGGCGG GAGGATTGCTTGAGCCTGGGGAGTTGAGACCAGCCTGGGCAACATA GCGAAACCCCGCCTCAGAAAAGAGAGGGAGAGAGGAAAGCAGTGG AGTTATTGGTCAAAGA | 4052 |
| UBE2D3 | GTGCTGTATAAACAGATGAGAGTGCCCCCACAGCATTGTTATTAGA | 4053 |

TABLE 25-continued

Gene Sequence

| Gene | Sequence | SEQ ID NO: |
|---|---|---|
| UBE2L3 | AATGACCACCTGAGAAGGAGTGTGCTGTAACCTCTGAGAAGCACTG TGCTGTGATAGA | 4054 |
| UBN2 | GATCACAACTTTTACAGATTTTTAAAATATTGGCCGGGCGCAGTGG CCCACACCTGTAATCCCAGCACTTTGGGAGGCTGAGGCAGGAGATC AAGACCATCCTGGCTAACACGATGAAATCCCGTCTCTACTGAAAAT ACACAAAATTAGCCAGGCGTGGTGACACACACCTGTAGTCCCAGCT ACTTGGGAGGCTGAGGCAGGAGGATCACCTAAACCCGGGAGGTGGA GATTGCAGTAAGCCGAGATCGCGCCACTGCACTCCAGCCTGGGCGA CAGA | 4055 |
| UNC13B | GTCACTGGACCTATTTGGGCTGGGGAGAACAACAGA | 4056 |
| URGCP-MRPS24 | GCTTTGGGGCAGTGGTCATTTCCGGGACCAGGCCTTTTCATTGCCA GCTGACTACCCAGCACTTTGAGCTCATGAATAGA | 4057 |
| UVRAG | GAACAAAGCCTGAGCCTCCAAGCCAGAAGCAAAGTTTGTATGCGTG GTTAGACAGGTTGTTTCTGATTGGAGAGAACCTGGAAAGAATTAAG CCAGTCACACACAGGTCCATCTCTGAAGCCCAGCCATCAGATCAGT CATCTGCTGGTCCTGGAGAGGAGTGAGTGGAGGACACAGAGAAACT GCAGATGCTCCTTTCATGACCTTTTCTCCTGAGAAATGGAGTGGGG CATTTGTCTCCTGTGTGGGAACATGGGAATGCAGA | 4058 |
| VDAC2 | ACATGGCAGCCCCTAGCATGTGTATCCTAAGA | 4059 |
| WDR27 | AGCTGCCCCTGGAGCAGAATATTCCCTGCTTGGTCCAAACCACAGA GA | 4060 |
| WDR90 | CCTCCTGGCAAGGAGCAGAGCTGGCGGGAGGCGGCTTTGGGGAAGA ATCTCTGTCCACAAAGA | 4061 |
| WHSC2 | GCTTTCTGCGGGAGCAGTGGTGGCCCCGGCTTCTCACCCTTCAGGT TTTCTTGCATCTGCGCACCGGTGGAAGA | 4062 |
| WNK1 | GTTGTCCAACATGTGAGCATTTTCTGGCTGGGGAGA | 4063 |
| XRN2 | CCATCAACAACTCTTAGCTGAAAGAGGGATAAGGCCCAAGCAAGGA TAGAGAGA | 4064 |
| ZFP82 | ATCTTTGTACATTATCCCTGTGTTGAAATGCAAATAGGACTTCCCT GGAACCAAATCTTCTATATCCCAGAACTTCTTGTATCAACAAAGTA AGATGGTTGATACAGTGCCCAAATAGA | 4065 |
| ZMIZ2 | GGGCACAGGGTCAAGGATACCAGACCTGGAGACTGGAAGTCTTTTC AGAGAGACTGTCCTCAGAGAGGAGACCAGAGGCATGAGTTCGGGTC GGCAGGAAATCCCCCTGTGCAGTGAAGA | 4066 |
| ZNF138 | GCCTCTGGAAGAGCAGGACCTCTCCCAGACTGTGATTGGGAGGAGT TTGGGATGGTTACAGA | 4067 |
| ZNF208 | GCTTCTGGAAGACAAAGACCTCTCACAGACTGTGGCTGGGAGGAGT TTGGGATGGTTACAGA | 4068 |
| ZNF212 | GAGGATGTATTTAAGCTTTTGTCTCATGTGTTCCATGATGAATTAA CTGACTTGAGTAACTAGA | 4069 |
| ZNF280D | AAATCAAGAAGTTTTAATATTTGAGCAGTGCTTATGGAGGTTTTAA AGAGAATATATTCCTCAAAATTCTAATTACTTCTGTGATTTTACTG CCTCCAGA | 4070 |
| ZNF350 | AGTCTTGCTCTGTGCCCAGGCTGGAGCGCAATGGTGTGAACTTGGC TCACCGCAACCTCCACCTCCTGGATTCAAGCGATTCTTGTGCCTAT CCCCAACACCAGCACCATACCTGGCACACGGTGATCATTCAGTAAG A | 4071 |
| ZNF37BP | AGTCAAGAACAGACACTGAGTCGCTTGAGGACTCAGGCAGGTGTTT GCTGCATTGACAACAGA | 4072 |
| ZNF426 | CTACTCAGGAGGCTGAAGCAGGAGAGTTGCTTGAACCTGGGAGGTG GAGGTTGCAGTGAGCCAAGATTGCACCAGTGCACTCCAGCCTGGGC AACAGA | 4073 |
| ZNF618 | AAACTGCAAGTCCCCTGATTTCCAACCCTTTCCCTCTCCTACAGA | 4074 |
| ZNF680 | GCAGAACTGGCCGTGAACTGTGGCTCAGGGAGCTGGAACTGAGTCA | 4075 |

TABLE 25-continued

Gene Sequence

| Gene | Sequence | SEQ ID NO: |
|---|---|---|
| | TCGAACTGCTTCAGAAACCACAGTAAAGGACAAGGTCTGCAGGCCT GCCTGCGTGGCTATAAATGGCTGTCTTCCTCCAGGCCTCTGGAAGG GCACGGTCTCTCCCAGACTGTGGCTGGGAGGAGTTTGGGATGATTA GAGA | |
| ZNF730 | GCCTCTGAAAAGGCAGGACCTCTTCCAGACTTTGGCTGGGAAGAGT TTTGGATGGTTTCAGA | 4076 |
| ZNF777 | GCCTCACTACTTCCTCATTCCCCATGTCGGAAACCCCAGGGTGGAA CCCAGACCACCTGAGCACACCTGCTGCAATGGACTGCTGCCCACTC CTAGGAGTGGTTGAATTGCCTGCCTTCACCTGCCTCGATGTCTCGC TCTGCTTATAGCAGAAGCCAGGCCAGAATACCCAGAAGCCCGTTCA GCCTCTACAGCAGGGGCCGGGCACATAGAAGATGTTTCCAAGTCAA ACATACATATACCATACTGACTCATTGATATGAGTCTGCAATGCAA CTGTTATCAAAGA | 4077 |
| ZNF804A | CTCTCTGTGTCAGATTTGACCTTGGAAGATCACAGAGGAAAAGCGA GAAGGA | 4078 |
| ZNF836 | TGCCTAAATGAAGACGTATGGGTCTTTTACTGTTTTTTGCTGTTAC AAAGAATGTCACCGTGGCTGCCTGTATGCATGCTATCTTTACCACA GATGTCTGAAGTTTCCTCCAGGTTGGGCAGTTTAAAGA | 4079 |
| ZSCAN25 | GCTCTGGGTGATCTGGTTTCTGTCTGCCTCTGCCACCTCTTCTGGT GCAGCTCTGCTCGTCACTGCTGAAGCCACACTGGGATATGGCTTGT TCTTGGACACCCAGA | 4080 |

Results:

For certain genes, where the values for splicing modification may have been considered statistically insignificant, the values in those instances prompted manual examination of RNAseq data for the likelihood of iExon production inclusion. Those events that demonstrated qualitative reads to support iExon inclusion were subsequently validated by end-point PCR. As demonstrated herein, the presence of an iExon has been demonstrated and validated for numerous targets.

It will be appreciated that, although specific aspects of the invention have been described herein for purposes of illustration, the invention described herein is not to be limited in scope by the specific aspects herein disclosed. These aspects are intended as illustrations of several aspects of the invention. Any equivalent aspects are intended to be within the scope of this invention. Indeed, various modifications of the invention in addition to those shown and described herein will become apparent to those skilled in the art from the foregoing description, which modification also intended to be within the scope of this invention.

All references cited herein are incorporated herein by reference in their entirety and for all purposes to the same extent as if each individual publication or patent or patent application was specifically and individually indicated to be incorporated by reference in its entirety for all purposes.

SEQUENCE LISTING (4080 sequences)

SEQ ID NO: 1 - RNA, 10 nt, Artificial Sequence
  Description of Artificial Sequence: Synthetic oligonucleotide
  modified_base (1)..(2): a, c, u, g, unknown or other
  modified_base (8)..(8): a, c, u, g, unknown or other
  modified_base (10)..(10): a, c, u, g, unknown or other
nngagurngn

SEQ ID NO: 2 - RNA, 10 nt, Artificial Sequence
  Description of Artificial Sequence: Synthetic oligonucleotide
  modified_base (1)..(2): a, c, u, g, unknown or other
nngaguragu

SEQ ID NO: 3 - RNA, 10 nt, Artificial Sequence
  Description of Artificial Sequence: Synthetic oligonucleotide
  modified_base (1)..(2): a, c, u, g, unknown or other
nngaguragu

SEQ ID NO: 4 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
  modified_base (10)..(10): a, c, u, g, unknown or other
angagurngn

SEQ ID NO: 5 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
  modified_base (10)..(10): a, c, u, g, unknown or other
cngagurngn

SEQ ID NO: 6 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
  modified_base (10)..(10): a, c, u, g, unknown or other
gngagurngn

SEQ ID NO: 7 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
  modified_base (10)..(10): a, c, u, g, unknown or other
ungagurngn

SEQ ID NO: 8 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
  modified_base (10)..(10): a, c, u, g, unknown or other
nagagurngn

SEQ ID NO: 9 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
  modified_base (10)..(10): a, c, u, g, unknown or other
ncgagurngn

SEQ ID NO: 10 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
  modified_base (10)..(10): a, c, u, g, unknown or other
nggagurngn

SEQ ID NO: 11 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
  modified_base (10)..(10): a, c, u, g, unknown or other
nugagurngn

SEQ ID NO: 12 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
aagagurngn

SEQ ID NO: 13 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
acgagurngn

SEQ ID NO: 14 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
aggagurngn

SEQ ID NO: 15 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
augagurngn

SEQ ID NO: 16 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
cagagurngn

SEQ ID NO: 17 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
ccgagurngn

SEQ ID NO: 18 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
cggagurngn

SEQ ID NO: 19 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
cugagurngn

SEQ ID NO: 20 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
gagagurngn

SEQ ID NO: 21 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
gcgagurngn

SEQ ID NO: 22 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
gggagurngn

SEQ ID NO: 23 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
gugagurngn

SEQ ID NO: 24 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
uagagurngn

SEQ ID NO: 25 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
ucgagurngn

SEQ ID NO: 26 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
uggagurngn

SEQ ID NO: 27 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
uugagurngn

SEQ ID NO: 28 - RNA, 10 nt, Artificial Sequence
  Description of Artificial Sequence: Synthetic oligonucleotide
  modified_base (2)..(2): a, c, u, g, unknown or other
angaguragu

SEQ ID NO: 29 - RNA, 10 nt, Artificial Sequence
  Description of Artificial Sequence: Synthetic oligonucleotide
  modified_base (2)..(2): a, c, u, g, unknown or other
cngaguragu

SEQ ID NO: 30 - RNA, 10 nt, Artificial Sequence
  Description of Artificial Sequence: Synthetic oligonucleotide
  modified_base (2)..(2): a, c, u, g, unknown or other
gngaguragu

SEQ ID NO: 31 - RNA, 10 nt, Artificial Sequence
  Description of Artificial Sequence: Synthetic oligonucleotide
  modified_base (2)..(2): a, c, u, g, unknown or other
ungaguragu

SEQ ID NO: 32 - RNA, 10 nt, Artificial Sequence
  Description of Artificial Sequence: Synthetic oligonucleotide
  modified_base (1)..(1): a, c, u, g, unknown or other
nagaguragu

SEQ ID NO: 33 - RNA, 10 nt, Artificial Sequence
  Description of Artificial Sequence: Synthetic oligonucleotide
  modified_base (1)..(1): a, c, u, g, unknown or other
ncgaguragu

SEQ ID NO: 34 - RNA, 10 nt, Artificial Sequence
  Description of Artificial Sequence: Synthetic oligonucleotide
  modified_base (1)..(1): a, c, u, g, unknown or other
nggaguragu

SEQ ID NO: 35 - RNA, 10 nt, Artificial Sequence
  Description of Artificial Sequence: Synthetic oligonucleotide
  modified_base (1)..(1): a, c, u, g, unknown or other
nugaguragu

SEQ ID NO: 36 - RNA, 10 nt, Artificial Sequence
  Description of Artificial Sequence: Synthetic oligonucleotide
aagaguragu

SEQ ID NO: 37 - RNA, 10 nt, Artificial Sequence
  Description of Artificial Sequence: Synthetic oligonucleotide
acgaguragu

SEQ ID NO: 38 - RNA, 10 nt, Artificial Sequence
  Description of Artificial Sequence: Synthetic oligonucleotide
aggaguragu

SEQ ID NO: 39 - RNA, 10 nt, Artificial Sequence
  Description of Artificial Sequence: Synthetic oligonucleotide
augaguragu

SEQ ID NO: 40 - RNA, 10 nt, Artificial Sequence
  Description of Artificial Sequence: Synthetic oligonucleotide
cagaguragu

SEQ ID NO: 41 - RNA, 10 nt, Artificial Sequence
  Description of Artificial Sequence: Synthetic oligonucleotide
ccgaguragu

SEQ ID NO: 42 - RNA, 10 nt, Artificial Sequence
  Description of Artificial Sequence: Synthetic oligonucleotide
cggaguragu

SEQ ID NO: 43 - RNA, 10 nt, Artificial Sequence
  Description of Artificial Sequence: Synthetic oligonucleotide
cugaguragu

SEQ ID NO: 44 - RNA, 10 nt, Artificial Sequence
  Description of Artificial Sequence: Synthetic oligonucleotide
gagaguragu

SEQ ID NO: 45 - RNA, 10 nt, Artificial Sequence
  Description of Artificial Sequence: Synthetic oligonucleotide
gcgaguragu

SEQ ID NO: 46 - RNA, 10 nt, Artificial Sequence
  Description of Artificial Sequence: Synthetic oligonucleotide
gggaguragu

SEQ ID NO: 47 - RNA, 10 nt, Artificial Sequence
  Description of Artificial Sequence: Synthetic oligonucleotide
gugaguragu

SEQ ID NO: 48 - RNA, 10 nt, Artificial Sequence
  Description of Artificial Sequence: Synthetic oligonucleotide
uagaguragu

SEQ ID NO: 49 - RNA, 10 nt, Artificial Sequence
  Description of Artificial Sequence: Synthetic oligonucleotide
ucgaguragu

SEQ ID NO: 50 - RNA, 10 nt, Artificial Sequence
  Description of Artificial Sequence: Synthetic oligonucleotide
uggaguragu

SEQ ID NO: 51 - RNA, 10 nt, Artificial Sequence
  Description of Artificial Sequence: Synthetic oligonucleotide
uugaguragu

SEQ ID NO: 52 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
uggagurngn

SEQ ID NO: 53 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
uugagurngn

SEQ ID NO: 54 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
angaguragn

SEQ ID NO: 55 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
angagurcgn

SEQ ID NO: 56 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
angagurggn

SEQ ID NO: 57 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
angagurugn

SEQ ID NO: 58 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
nagaguragn

SEQ ID NO: 59 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
nagagurcgn

SEQ ID NO: 60 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
nagagurggn

SEQ ID NO: 61 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
nagagurugn

SEQ ID NO: 62 - RNA, 10 nt, Artificial Sequence
  Description of Artificial Sequence: Synthetic oligonucleotide
  modified_base (10)..(10): a, c, u, g, unknown or other
aagaguragn

SEQ ID NO: 63 - RNA, 10 nt, Artificial Sequence
  Description of Artificial Sequence: Synthetic oligonucleotide
  modified_base (10)..(10): a, c, u, g, unknown or other
aagagurcgn

SEQ ID NO: 64 - RNA, 10 nt, Artificial Sequence
  Description of Artificial Sequence: Synthetic oligonucleotide
  modified_base (10)..(10): a, c, u, g, unknown or other
aagagurggn

SEQ ID NO: 65 - RNA, 10 nt, Artificial Sequence
  Description of Artificial Sequence: Synthetic oligonucleotide
  modified_base (10)..(10): a, c, u, g, unknown or other
aagagurugn

SEQ ID NO: 66 - RNA, 10 nt, Artificial Sequence
  Description of Artificial Sequence: Synthetic oligonucleotide
  modified_base (10)..(10): a, c, u, g, unknown or other
cagaguragn

SEQ ID NO: 67 - RNA, 10 nt, Artificial Sequence
  Description of Artificial Sequence: Synthetic oligonucleotide
  modified_base (10)..(10): a, c, u, g, unknown or other
cagagurcgn

SEQ ID NO: 68 - RNA, 10 nt, Artificial Sequence
  Description of Artificial Sequence: Synthetic oligonucleotide
  modified_base (10)..(10): a, c, u, g, unknown or other
cagagurggn

SEQ ID NO: 69 - RNA, 10 nt, Artificial Sequence
  Description of Artificial Sequence: Synthetic oligonucleotide
  modified_base (10)..(10): a, c, u, g, unknown or other
cagagurugn

SEQ ID NO: 70 - RNA, 10 nt, Artificial Sequence
  Description of Artificial Sequence: Synthetic oligonucleotide
  modified_base (10)..(10): a, c, u, g, unknown or other
gagaguragn

SEQ ID NO: 71 - RNA, 10 nt, Artificial Sequence
  Description of Artificial Sequence: Synthetic oligonucleotide
  modified_base (10)..(10): a, c, u, g, unknown or other
gagagurcgn

SEQ ID NO: 72 - RNA, 10 nt, Artificial Sequence
  Description of Artificial Sequence: Synthetic oligonucleotide
  modified_base (10)..(10): a, c, u, g, unknown or other
gagagurggn

SEQ ID NO: 73 - RNA, 10 nt, Artificial Sequence
  Description of Artificial Sequence: Synthetic oligonucleotide
  modified_base (10)..(10): a, c, u, g, unknown or other
gagagurugn

SEQ ID NO: 74 - RNA, 10 nt, Artificial Sequence
  Description of Artificial Sequence: Synthetic oligonucleotide
  modified_base (10)..(10): a, c, u, g, unknown or other
uagaguragn

SEQ ID NO: 75 - RNA, 10 nt, Artificial Sequence
  Description of Artificial Sequence: Synthetic oligonucleotide
  modified_base (10)..(10): a, c, u, g, unknown or other
uagagurcgn

SEQ ID NO: 76 - RNA, 10 nt, Artificial Sequence
  Description of Artificial Sequence: Synthetic oligonucleotide
  modified_base (10)..(10): a, c, u, g, unknown or other
uagagurggn

SEQ ID NO: 77 - RNA, 10 nt, Artificial Sequence
  Description of Artificial Sequence: Synthetic oligonucleotide
  modified_base (10)..(10): a, c, u, g, unknown or other
uagagurugn

SEQ ID NO: 78 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
cngaguragn

SEQ ID NO: 79 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
cngagurcgn

SEQ ID NO: 80 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
cngagurggn

SEQ ID NO: 81 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
cngagurugn

SEQ ID NO: 82 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
ncgaguragn

SEQ ID NO: 83 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
ncgagurcgn

SEQ ID NO: 84 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
ncgagurggn

SEQ ID NO: 85 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
ncgagurugn

SEQ ID NO: 86 - RNA, 10 nt, Artificial Sequence
  Description of Artificial Sequence: Synthetic oligonucleotide
  modified_base (10)..(10): a, c, u, g, unknown or other
acgaguragn

SEQ ID NO: 87 - RNA, 10 nt, Artificial Sequence
  Description of Artificial Sequence: Synthetic oligonucleotide
  modified_base (10)..(10): a, c, u, g, unknown or other
acgagurcgn

SEQ ID NO: 88 - RNA, 10 nt, Artificial Sequence
  Description of Artificial Sequence: Synthetic oligonucleotide
  modified_base (10)..(10): a, c, u, g, unknown or other
acgagurggn

SEQ ID NO: 89 - RNA, 10 nt, Artificial Sequence
  Description of Artificial Sequence: Synthetic oligonucleotide
  modified_base (10)..(10): a, c, u, g, unknown or other
acgagurugn

SEQ ID NO: 90 - RNA, 10 nt, Artificial Sequence
  Description of Artificial Sequence: Synthetic oligonucleotide
  modified_base (10)..(10): a, c, u, g, unknown or other
ccgaguragn

SEQ ID NO: 91 - RNA, 10 nt, Artificial Sequence
  Description of Artificial Sequence: Synthetic oligonucleotide
  modified_base (10)..(10): a, c, u, g, unknown or other
ccgagurcgn

SEQ ID NO: 92 - RNA, 10 nt, Artificial Sequence
  Description of Artificial Sequence: Synthetic oligonucleotide
  modified_base (10)..(10): a, c, u, g, unknown or other
ccgagurggn

SEQ ID NO: 93 - RNA, 10 nt, Artificial Sequence
  Description of Artificial Sequence: Synthetic oligonucleotide
  modified_base (10)..(10): a, c, u, g, unknown or other
ccgagurugn

SEQ ID NO: 94 - RNA, 10 nt, Artificial Sequence
  Description of Artificial Sequence: Synthetic oligonucleotide
  modified_base (10)..(10): a, c, u, g, unknown or other
gcgaguragn

SEQ ID NO: 95 - RNA, 10 nt, Artificial Sequence
  Description of Artificial Sequence: Synthetic oligonucleotide
  modified_base (10)..(10): a, c, u, g, unknown or other
gcgagurcgn

SEQ ID NO: 96 - RNA, 10 nt, Artificial Sequence
  Description of Artificial Sequence: Synthetic oligonucleotide
  modified_base (10)..(10): a, c, u, g, unknown or other
gcgagurggn

SEQ ID NO: 97 - RNA, 10 nt, Artificial Sequence
  Description of Artificial Sequence: Synthetic oligonucleotide
  modified_base (10)..(10): a, c, u, g, unknown or other
gcgagurugn

SEQ ID NO: 98 - RNA, 10 nt, Artificial Sequence
  Description of Artificial Sequence: Synthetic oligonucleotide
  modified_base (10)..(10): a, c, u, g, unknown or other
ucgaguragn

SEQ ID NO: 99 - RNA, 10 nt, Artificial Sequence
  Description of Artificial Sequence: Synthetic oligonucleotide
  modified_base (10)..(10): a, c, u, g, unknown or other
ucgagurcgn

SEQ ID NO: 100 - RNA, 10 nt, Artificial Sequence
  Description of Artificial Sequence: Synthetic oligonucleotide
  modified_base (10)..(10): a, c, u, g, unknown or other
ucgagurggn

SEQ ID NO: 101 - RNA, 10 nt, Artificial Sequence
  Description of Artificial Sequence: Synthetic oligonucleotide
  modified_base (10)..(10): a, c, u, g, unknown or other
ucgagurugn

SEQ ID NO: 102 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
gngaguragn

SEQ ID NO: 103 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
gngagurcgn

SEQ ID NO: 104 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
gngagurggn

SEQ ID NO: 105 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
gngagurugn

SEQ ID NO: 106 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
nggaguragn

SEQ ID NO: 107 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
nggagurcgn

SEQ ID NO: 108 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
nggagurggn

SEQ ID NO: 109 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
nggagurugn

SEQ ID NO: 110 - RNA, 10 nt, Artificial Sequence
  Description of Artificial Sequence: Synthetic oligonucleotide
  modified_base (10)..(10): a, c, u, g, unknown or other
aggaguragn

SEQ ID NO: 111 - RNA, 10 nt, Artificial Sequence
  Description of Artificial Sequence: Synthetic oligonucleotide
  modified_base (10)..(10): a, c, u, g, unknown or other
aggagurcgn

SEQ ID NO: 112 - RNA, 10 nt, Artificial Sequence
  Description of Artificial Sequence: Synthetic oligonucleotide
  modified_base (10)..(10): a, c, u, g, unknown or other
aggagurggn

SEQ ID NO: 113 - RNA, 10 nt, Artificial Sequence
  Description of Artificial Sequence: Synthetic oligonucleotide
  modified_base (10)..(10): a, c, u, g, unknown or other
aggagurugn

SEQ ID NO: 114 - RNA, 10 nt, Artificial Sequence
  Description of Artificial Sequence: Synthetic oligonucleotide
  modified_base (10)..(10): a, c, u, g, unknown or other
cggaguragn

SEQ ID NO: 115 - RNA, 10 nt, Artificial Sequence
  Description of Artificial Sequence: Synthetic oligonucleotide
  modified_base (10)..(10): a, c, u, g, unknown or other
cggagurcgn

SEQ ID NO: 116 - RNA, 10 nt, Artificial Sequence
  Description of Artificial Sequence: Synthetic oligonucleotide
  modified_base (10)..(10): a, c, u, g, unknown or other
cggagurggn

SEQ ID NO: 117 - RNA, 10 nt, Artificial Sequence
  Description of Artificial Sequence: Synthetic oligonucleotide
  modified_base (10)..(10): a, c, u, g, unknown or other
cggagurugn

SEQ ID NO: 118 - RNA, 10 nt, Artificial Sequence
  Description of Artificial Sequence: Synthetic oligonucleotide
  modified_base (10)..(10): a, c, u, g, unknown or other
gggaguragn

SEQ ID NO: 119 - RNA, 10 nt, Artificial Sequence
  Description of Artificial Sequence: Synthetic oligonucleotide
  modified_base (10)..(10): a, c, u, g, unknown or other
gggagurcgn

SEQ ID NO: 120 - RNA, 10 nt, Artificial Sequence
  Description of Artificial Sequence: Synthetic oligonucleotide
  modified_base (10)..(10): a, c, u, g, unknown or other
gggagurggn

SEQ ID NO: 121 - RNA, 10 nt, Artificial Sequence
  Description of Artificial Sequence: Synthetic oligonucleotide
  modified_base (10)..(10): a, c, u, g, unknown or other
gggagurugn

SEQ ID NO: 122 - RNA, 10 nt, Artificial Sequence
  Description of Artificial Sequence: Synthetic oligonucleotide
  modified_base (10)..(10): a, c, u, g, unknown or other
uggaguragn

SEQ ID NO: 123 - RNA, 10 nt, Artificial Sequence
  Description of Artificial Sequence: Synthetic oligonucleotide
  modified_base (10)..(10): a, c, u, g, unknown or other
uggagurcgn

SEQ ID NO: 124 - RNA, 10 nt, Artificial Sequence
  Description of Artificial Sequence: Synthetic oligonucleotide
  modified_base (10)..(10): a, c, u, g, unknown or other
uggagurggn

SEQ ID NO: 125 - RNA, 10 nt, Artificial Sequence
  Description of Artificial Sequence: Synthetic oligonucleotide
  modified_base (10)..(10): a, c, u, g, unknown or other
uggagurugn

SEQ ID NO: 126 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
ungaguragn

SEQ ID NO: 127 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
ungagurcgn

SEQ ID NO: 128 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
ungagurggn

SEQ ID NO: 129 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
ungagurugn

SEQ ID NO: 130 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
nugaguragn

SEQ ID NO: 131 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
nugagurcgn

SEQ ID NO: 132 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
nugagurggn

SEQ ID NO: 133 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
nugagurugn

SEQ ID NO: 134 - RNA, 10 nt, Artificial Sequence
  Description of Artificial Sequence: Synthetic oligonucleotide
  modified_base (10)..(10): a, c, u, g, unknown or other
augaguragn

SEQ ID NO: 135 - RNA, 10 nt, Artificial Sequence
  Description of Artificial Sequence: Synthetic oligonucleotide
  modified_base (10)..(10): a, c, u, g, unknown or other
augagurcgn

SEQ ID NO: 136 - RNA, 10 nt, Artificial Sequence
  Description of Artificial Sequence: Synthetic oligonucleotide
  modified_base (10)..(10): a, c, u, g, unknown or other
augagurggn

SEQ ID NO: 137 - RNA, 10 nt, Artificial Sequence
  Description of Artificial Sequence: Synthetic oligonucleotide
  modified_base (10)..(10): a, c, u, g, unknown or other
augagurugn

SEQ ID NO: 138 - RNA, 10 nt, Artificial Sequence
  Description of Artificial Sequence: Synthetic oligonucleotide
  modified_base (10)..(10): a, c, u, g, unknown or other
cugaguragn

SEQ ID NO: 139 - RNA, 10 nt, Artificial Sequence
  Description of Artificial Sequence: Synthetic oligonucleotide
  modified_base (10)..(10): a, c, u, g, unknown or other
cugagurcgn

SEQ ID NO: 140 - RNA, 10 nt, Artificial Sequence
  Description of Artificial Sequence: Synthetic oligonucleotide
  modified_base (10)..(10): a, c, u, g, unknown or other
cugagurggn

SEQ ID NO: 141 - RNA, 10 nt, Artificial Sequence
  Description of Artificial Sequence: Synthetic oligonucleotide
  modified_base (10)..(10): a, c, u, g, unknown or other
cugagurugn

SEQ ID NO: 142 - RNA, 10 nt, Artificial Sequence
  Description of Artificial Sequence: Synthetic oligonucleotide
  modified_base (10)..(10): a, c, u, g, unknown or other
gugaguragn

SEQ ID NO: 143 - RNA, 10 nt, Artificial Sequence
  Description of Artificial Sequence: Synthetic oligonucleotide
  modified_base (10)..(10): a, c, u, g, unknown or other
gugagurcgn

SEQ ID NO: 144 - RNA, 10 nt, Artificial Sequence
  Description of Artificial Sequence: Synthetic oligonucleotide
  modified_base (10)..(10): a, c, u, g, unknown or other
gugagurggn

SEQ ID NO: 145 - RNA, 10 nt, Artificial Sequence
  Description of Artificial Sequence: Synthetic oligonucleotide
  modified_base (10)..(10): a, c, u, g, unknown or other
gugagurugn

SEQ ID NO: 146 - RNA, 10 nt, Artificial Sequence
  Description of Artificial Sequence: Synthetic oligonucleotide
  modified_base (10)..(10): a, c, u, g, unknown or other
uugaguragn

SEQ ID NO: 147 - RNA, 10 nt, Artificial Sequence
  Description of Artificial Sequence: Synthetic oligonucleotide
  modified_base (10)..(10): a, c, u, g, unknown or other
uugagurcgn

SEQ ID NO: 148 - RNA, 10 nt, Artificial Sequence
  Description of Artificial Sequence: Synthetic oligonucleotide
  modified_base (10)..(10): a, c, u, g, unknown or other
uugagurggn

SEQ ID NO: 149 - RNA, 10 nt, Artificial Sequence
  Description of Artificial Sequence: Synthetic oligonucleotide
  modified_base (10)..(10): a, c, u, g, unknown or other
uugagurugn

SEQ ID NO: 150 - RNA, 10 nt, Artificial Sequence
  Description of Artificial Sequence: Synthetic oligonucleotide
  modified_base (2)..(2): a, c, u, g, unknown or other
angaguraga

SEQ ID NO: 151 - RNA, 10 nt, Artificial Sequence
  Description of Artificial Sequence: Synthetic oligonucleotide
  modified_base (2)..(2): a, c, u, g, unknown or other
angagurcga

SEQ ID NO: 152 - RNA, 10 nt, Artificial Sequence
  Description of Artificial Sequence: Synthetic oligonucleotide
  modified_base (2)..(2): a, c, u, g, unknown or other
angagurgga

SEQ ID NO: 153 - RNA, 10 nt, Artificial Sequence
  Description of Artificial Sequence: Synthetic oligonucleotide
  modified_base (2)..(2): a, c, u, g, unknown or other
angaguruga

SEQ ID NO: 154 - RNA, 10 nt, Artificial Sequence
  Description of Artificial Sequence: Synthetic oligonucleotide
  modified_base (1)..(1): a, c, u, g, unknown or other
nagaguraga

SEQ ID NO: 155 - RNA, 10 nt, Artificial Sequence
  Description of Artificial Sequence: Synthetic oligonucleotide
  modified_base (1)..(1): a, c, u, g, unknown or other
nagagurcga

SEQ ID NO: 156 - RNA, 10 nt, Artificial Sequence
  Description of Artificial Sequence: Synthetic oligonucleotide
  modified_base (1)..(1): a, c, u, g, unknown or other
nagagurgga

SEQ ID NO: 157 - RNA, 10 nt, Artificial Sequence
  Description of Artificial Sequence: Synthetic oligonucleotide
  modified_base (1)..(1): a, c, u, g, unknown or other
nagaguruga

SEQ ID NO: 158 - RNA, 10 nt, Artificial Sequence
  Description of Artificial Sequence: Synthetic oligonucleotide
aagaguraga

SEQ ID NO: 159 - RNA, 10 nt, Artificial Sequence
  Description of Artificial Sequence: Synthetic oligonucleotide
aagagurcga

SEQ ID NO: 160 - RNA, 10 nt, Artificial Sequence
  Description of Artificial Sequence: Synthetic oligonucleotide
aagagurgga

SEQ ID NO: 161 - RNA, 10 nt, Artificial Sequence
  Description of Artificial Sequence: Synthetic oligonucleotide
aagaguruga

SEQ ID NO: 162 - RNA, 10 nt, Artificial Sequence
  Description of Artificial Sequence: Synthetic oligonucleotide
cagaguraga

SEQ ID NO: 163 - RNA, 10 nt, Artificial Sequence
  Description of Artificial Sequence: Synthetic oligonucleotide
cagagurcga

SEQ ID NO: 164 - RNA, 10 nt, Artificial Sequence
  Description of Artificial Sequence: Synthetic oligonucleotide
cagagurgga

SEQ ID NO: 165 - RNA, 10 nt, Artificial Sequence
  Description of Artificial Sequence: Synthetic oligonucleotide
cagaguruga

SEQ ID NO: 166 - RNA, 10 nt, Artificial Sequence
  Description of Artificial Sequence: Synthetic oligonucleotide
gagaguraga

SEQ ID NO: 167 - RNA, 10 nt, Artificial Sequence
  Description of Artificial Sequence: Synthetic oligonucleotide
gagagurcga

SEQ ID NO: 168 - RNA, 10 nt, Artificial Sequence
  Description of Artificial Sequence: Synthetic oligonucleotide
gagagurgga

SEQ ID NO: 169 - RNA, 10 nt, Artificial Sequence
  Description of Artificial Sequence: Synthetic oligonucleotide
gagaguruga

SEQ ID NO: 170 - RNA, 10 nt, Artificial Sequence
  Description of Artificial Sequence: Synthetic oligonucleotide
uagaguraga

SEQ ID NO: 171 - RNA, 10 nt, Artificial Sequence
  Description of Artificial Sequence: Synthetic oligonucleotide
uagagurcga

SEQ ID NO: 172 - RNA, 10 nt, Artificial Sequence
  Description of Artificial Sequence: Synthetic oligonucleotide
uagagurgga

SEQ ID NO: 173 - RNA, 10 nt, Artificial Sequence
  Description of Artificial Sequence: Synthetic oligonucleotide
uagaguruga

SEQ ID NO: 174 - RNA, 10 nt, Artificial Sequence
  Description of Artificial Sequence: Synthetic oligonucleotide
  modified_base (2)..(2): a, c, u, g, unknown or other
cngaguraga

SEQ ID NO: 175 - RNA, 10 nt, Artificial Sequence
  Description of Artificial Sequence: Synthetic oligonucleotide
  modified_base (2)..(2): a, c, u, g, unknown or other
cngagurcga

SEQ ID NO: 176 - RNA, 10 nt, Artificial Sequence
  Description of Artificial Sequence: Synthetic oligonucleotide
  modified_base (2)..(2): a, c, u, g, unknown or other
cngagurgga

SEQ ID NO: 177 - RNA, 10 nt, Artificial Sequence
  Description of Artificial Sequence: Synthetic oligonucleotide
  modified_base (2)..(2): a, c, u, g, unknown or other
cngaguruga

SEQ ID NO: 178 - RNA, 10 nt, Artificial Sequence
  Description of Artificial Sequence: Synthetic oligonucleotide
  modified_base (1)..(1): a, c, u, g, unknown or other
ncgaguraga

SEQ ID NO: 179 - RNA, 10 nt, Artificial Sequence
  Description of Artificial Sequence: Synthetic oligonucleotide
  modified_base (1)..(1): a, c, u, g, unknown or other
ncgagurcga

SEQ ID NO: 180 - RNA, 10 nt, Artificial Sequence
  Description of Artificial Sequence: Synthetic oligonucleotide
  modified_base (1)..(1): a, c, u, g, unknown or other
ncgagurgga

SEQ ID NO: 181 - RNA, 10 nt, Artificial Sequence
  Description of Artificial Sequence: Synthetic oligonucleotide
  modified_base (1)..(1): a, c, u, g, unknown or other
ncgaguruga

SEQ ID NO: 182 - RNA, 10 nt, Artificial Sequence
  Description of Artificial Sequence: Synthetic oligonucleotide
acgaguraga

SEQ ID NO: 183 - RNA, 10 nt, Artificial Sequence
  Description of Artificial Sequence: Synthetic oligonucleotide
acgagurcga

SEQ ID NO: 184 - RNA, 10 nt, Artificial Sequence
  Description of Artificial Sequence: Synthetic oligonucleotide
acgagurgga

SEQ ID NO: 185 - RNA, 10 nt, Artificial Sequence
  Description of Artificial Sequence: Synthetic oligonucleotide
acgaguruga

SEQ ID NO: 186 - RNA, 10 nt, Artificial Sequence
  Description of Artificial Sequence: Synthetic oligonucleotide
ccgaguraga

SEQ ID NO: 187 - RNA, 10 nt, Artificial Sequence
  Description of Artificial Sequence: Synthetic oligonucleotide
ccgagurcga

SEQ ID NO: 188 - RNA, 10 nt, Artificial Sequence
  Description of Artificial Sequence: Synthetic oligonucleotide
ccgagurgga

SEQ ID NO: 189 - RNA, 10 nt, Artificial Sequence
  Description of Artificial Sequence: Synthetic oligonucleotide
ccgaguruga

SEQ ID NO: 190 - RNA, 10 nt, Artificial Sequence
  Description of Artificial Sequence: Synthetic oligonucleotide
gcgaguraga

SEQ ID NO: 191 - RNA, 10 nt, Artificial Sequence
  Description of Artificial Sequence: Synthetic oligonucleotide
gcgagurcga

SEQ ID NO: 192 - RNA, 10 nt, Artificial Sequence
  Description of Artificial Sequence: Synthetic oligonucleotide
gcgagurgga

SEQ ID NO: 193 - RNA, 10 nt, Artificial Sequence
  Description of Artificial Sequence: Synthetic oligonucleotide
gcgaguruga

SEQ ID NO: 194 - RNA, 10 nt, Artificial Sequence
  Description of Artificial Sequence: Synthetic oligonucleotide
ucgaguraga

SEQ ID NO: 195 - RNA, 10 nt, Artificial Sequence
  Description of Artificial Sequence: Synthetic oligonucleotide
ucgagurcga

SEQ ID NO: 196 - RNA, 10 nt, Artificial Sequence
  Description of Artificial Sequence: Synthetic oligonucleotide
ucgagurgga

SEQ ID NO: 197 - RNA, 10 nt, Artificial Sequence
  Description of Artificial Sequence: Synthetic oligonucleotide
ucgaguruga

SEQ ID NO: 198 - RNA, 10 nt, Artificial Sequence
  Description of Artificial Sequence: Synthetic oligonucleotide
  modified_base (2)..(2): a, c, u, g, unknown or other
gngaguraga

SEQ ID NO: 199 - RNA, 10 nt, Artificial Sequence
  Description of Artificial Sequence: Synthetic oligonucleotide
  modified_base (2)..(2): a, c, u, g, unknown or other
gngagurcga

SEQ ID NO: 200 - RNA, 10 nt, Artificial Sequence
  Description of Artificial Sequence: Synthetic oligonucleotide
  modified_base (2)..(2): a, c, u, g, unknown or other
gngagurgga

SEQ ID NO: 201 - RNA, 10 nt, Artificial Sequence
  Description of Artificial Sequence: Synthetic oligonucleotide
  modified_base (2)..(2): a, c, u, g, unknown or other
gngaguruga

SEQ ID NO: 202 - RNA, 10 nt, Artificial Sequence
  Description of Artificial Sequence: Synthetic oligonucleotide
  modified_base (1)..(1): a, c, u, g, unknown or other
nggaguraga

SEQ ID NO: 203 - RNA, 10 nt, Artificial Sequence
  Description of Artificial Sequence: Synthetic oligonucleotide
  modified_base (1)..(1): a, c, u, g, unknown or other
nggagurcga

SEQ ID NO: 204 - RNA, 10 nt, Artificial Sequence
  Description of Artificial Sequence: Synthetic oligonucleotide
  modified_base (1)..(1): a, c, u, g, unknown or other
nggagurgga

SEQ ID NO: 205 - RNA, 10 nt, Artificial Sequence
  Description of Artificial Sequence: Synthetic oligonucleotide
  modified_base (1)..(1): a, c, u, g, unknown or other
nggaguruga

SEQ ID NO: 206 - RNA, 10 nt, Artificial Sequence
  Description of Artificial Sequence: Synthetic oligonucleotide
aggaguraga

SEQ ID NO: 207 - RNA, 10 nt, Artificial Sequence
  Description of Artificial Sequence: Synthetic oligonucleotide
aggagurcga

SEQ ID NO: 208 - RNA, 10 nt, Artificial Sequence
  Description of Artificial Sequence: Synthetic oligonucleotide
aggagurgga

SEQ ID NO: 209 - RNA, 10 nt, Artificial Sequence
  Description of Artificial Sequence: Synthetic oligonucleotide
aggaguruga

SEQ ID NO: 210 - RNA, 10 nt, Artificial Sequence
  Description of Artificial Sequence: Synthetic oligonucleotide
cggaguraga

SEQ ID NO: 211 - RNA, 10 nt, Artificial Sequence
  Description of Artificial Sequence: Synthetic oligonucleotide
cggagurcga

SEQ ID NO: 212 - RNA, 10 nt, Artificial Sequence
  Description of Artificial Sequence: Synthetic oligonucleotide
cggagurgga

SEQ ID NO: 213 - RNA, 10 nt, Artificial Sequence
  Description of Artificial Sequence: Synthetic oligonucleotide
cggaguruga

SEQ ID NO: 214 - RNA, 10 nt, Artificial Sequence
  Description of Artificial Sequence: Synthetic oligonucleotide
gggaguraga

SEQ ID NO: 215 - RNA, 10 nt, Artificial Sequence
  Description of Artificial Sequence: Synthetic oligonucleotide
gggagurcga

SEQ ID NO: 216 - RNA, 10 nt, Artificial Sequence
  Description of Artificial Sequence: Synthetic oligonucleotide
gggagurgga

SEQ ID NO: 217 - RNA, 10 nt, Artificial Sequence
  Description of Artificial Sequence: Synthetic oligonucleotide
gggaguruga

SEQ ID NO: 218 - RNA, 10 nt, Artificial Sequence
  Description of Artificial Sequence: Synthetic oligonucleotide
uggaguraga

SEQ ID NO: 219 - RNA, 10 nt, Artificial Sequence
  Description of Artificial Sequence: Synthetic oligonucleotide
uggagurcga

SEQ ID NO: 220 - RNA, 10 nt, Artificial Sequence
  Description of Artificial Sequence: Synthetic oligonucleotide
uggagurgga

SEQ ID NO: 221 - RNA, 10 nt, Artificial Sequence
  Description of Artificial Sequence: Synthetic oligonucleotide
uggaguruga

SEQ ID NO: 222 - RNA, 10 nt, Artificial Sequence
  Description of Artificial Sequence: Synthetic oligonucleotide
  modified_base (2)..(2): a, c, u, g, unknown or other
ungaguraga

SEQ ID NO: 223 - RNA, 10 nt, Artificial Sequence
  Description of Artificial Sequence: Synthetic oligonucleotide
  modified_base (2)..(2): a, c, u, g, unknown or other
ungagurcga

SEQ ID NO: 224 - RNA, 10 nt, Artificial Sequence
  Description of Artificial Sequence: Synthetic oligonucleotide
  modified_base (2)..(2): a, c, u, g, unknown or other
ungagurgga

SEQ ID NO: 225 - RNA, 10 nt, Artificial Sequence
  Description of Artificial Sequence: Synthetic oligonucleotide
  modified_base (2)..(2): a, c, u, g, unknown or other
ungaguruga

SEQ ID NO: 226 - RNA, 10 nt, Artificial Sequence
  Description of Artificial Sequence: Synthetic oligonucleotide
  modified_base (1)..(1): a, c, u, g, unknown or other
nugaguraga

SEQ ID NO: 227 - RNA, 10 nt, Artificial Sequence
  Description of Artificial Sequence: Synthetic oligonucleotide
  modified_base (1)..(1): a, c, u, g, unknown or other
nugagurcga

SEQ ID NO: 228 - RNA, 10 nt, Artificial Sequence
  Description of Artificial Sequence: Synthetic oligonucleotide
  modified_base (1)..(1): a, c, u, g, unknown or other
nugagurgga

SEQ ID NO: 229 - RNA, 10 nt, Artificial Sequence
  Description of Artificial Sequence: Synthetic oligonucleotide
  modified_base (1)..(1): a, c, u, g, unknown or other
nugaguruga

SEQ ID NO: 230 - RNA, 10 nt, Artificial Sequence
  Description of Artificial Sequence: Synthetic oligonucleotide
augaguraga

SEQ ID NO: 231 - RNA, 10 nt, Artificial Sequence
  Description of Artificial Sequence: Synthetic oligonucleotide
augagurcga

SEQ ID NO: 232 - RNA, 10 nt, Artificial Sequence
  Description of Artificial Sequence: Synthetic oligonucleotide
augagurgga

SEQ ID NO: 233 - RNA, 10 nt, Artificial Sequence
  Description of Artificial Sequence: Synthetic oligonucleotide
augaguruga

SEQ ID NO: 234 - RNA, 10 nt, Artificial Sequence
  Description of Artificial Sequence: Synthetic oligonucleotide
cugaguraga

SEQ ID NO: 235 - RNA, 10 nt, Artificial Sequence
  Description of Artificial Sequence: Synthetic oligonucleotide
cugagurcga

SEQ ID NO: 236 - RNA, 10 nt, Artificial Sequence
  Description of Artificial Sequence: Synthetic oligonucleotide
cugagurgga

SEQ ID NO: 237 - RNA, 10 nt, Artificial Sequence
  Description of Artificial Sequence: Synthetic oligonucleotide
cugaguruga

SEQ ID NO: 238 - RNA, 10 nt, Artificial Sequence
  Description of Artificial Sequence: Synthetic oligonucleotide
gugaguraga

SEQ ID NO: 239 - RNA, 10 nt, Artificial Sequence
  Description of Artificial Sequence: Synthetic oligonucleotide
gugagurcga

SEQ ID NO: 240 - RNA, 10 nt, Artificial Sequence
  Description of Artificial Sequence: Synthetic oligonucleotide
gugagurgga

SEQ ID NO: 241 - RNA, 10 nt, Artificial Sequence
  Description of Artificial Sequence: Synthetic oligonucleotide
gugaguruga

SEQ ID NO: 242 - RNA, 10 nt, Artificial Sequence
  Description of Artificial Sequence: Synthetic oligonucleotide
uugaguraga

SEQ ID NO: 243 - RNA, 10 nt, Artificial Sequence
  Description of Artificial Sequence: Synthetic oligonucleotide
uugagurcga

SEQ ID NO: 244 - RNA, 10 nt, Artificial Sequence
  Description of Artificial Sequence: Synthetic oligonucleotide
uugagurgga

SEQ ID NO: 245 - RNA, 10 nt, Artificial Sequence
  Description of Artificial Sequence: Synthetic oligonucleotide
uugaguruga

SEQ ID NO: 246 - RNA, 10 nt, Artificial Sequence
  Description of Artificial Sequence: Synthetic oligonucleotide
  modified_base (2)..(2): a, c, u, g, unknown or other
angaguragc

SEQ ID NO: 247 - RNA, 10 nt, Artificial Sequence
  Description of Artificial Sequence: Synthetic oligonucleotide
  modified_base (2)..(2): a, c, u, g, unknown or other
angagurcgc

SEQ ID NO: 248 - RNA, 10 nt, Artificial Sequence
  Description of Artificial Sequence: Synthetic oligonucleotide
  modified_base (2)..(2): a, c, u, g, unknown or other
angagurggc

SEQ ID NO: 249 - RNA, 10 nt, Artificial Sequence
  Description of Artificial Sequence: Synthetic oligonucleotide
  modified_base (2)..(2): a, c, u, g, unknown or other
angagurugc

SEQ ID NO: 250 - RNA, 10 nt, Artificial Sequence
  Description of Artificial Sequence: Synthetic oligonucleotide
  modified_base (1)..(1): a, c, u, g, unknown or other
nagaguragc

SEQ ID NO: 251 - RNA, 10 nt, Artificial Sequence
  Description of Artificial Sequence: Synthetic oligonucleotide
  modified_base (1)..(1): a, c, u, g, unknown or other
nagagurcgc

SEQ ID NO: 252 - RNA, 10 nt, Artificial Sequence
  Description of Artificial Sequence: Synthetic oligonucleotide
  modified_base (1)..(1): a, c, u, g, unknown or other
nagagurggc

SEQ ID NO: 253 - RNA, 10 nt, Artificial Sequence
  Description of Artificial Sequence: Synthetic oligonucleotide
  modified_base (1)..(1): a, c, u, g, unknown or other
nagagurugc

SEQ ID NO: 254 - RNA, 10 nt, Artificial Sequence
  Description of Artificial Sequence: Synthetic oligonucleotide
aagaguragc

SEQ ID NO: 255 - RNA, 10 nt, Artificial Sequence
  Description of Artificial Sequence: Synthetic oligonucleotide
aagagurcgc

SEQ ID NO: 256 - RNA, 10 nt, Artificial Sequence
  Description of Artificial Sequence: Synthetic oligonucleotide
aagagurggc

SEQ ID NO: 257 - RNA, 10 nt, Artificial Sequence
  Description of Artificial Sequence: Synthetic oligonucleotide
aagagurugc

SEQ ID NO: 258 - RNA, 10 nt, Artificial Sequence
  Description of Artificial Sequence: Synthetic oligonucleotide
cagaguragc

SEQ ID NO: 259 - RNA, 10 nt, Artificial Sequence
  Description of Artificial Sequence: Synthetic oligonucleotide
cagagurcgc

SEQ ID NO: 260 - RNA, 10 nt, Artificial Sequence
  Description of Artificial Sequence: Synthetic oligonucleotide
cagagurggc

SEQ ID NO: 261 - RNA, 10 nt, Artificial Sequence
  Description of Artificial Sequence: Synthetic oligonucleotide
cagagurugc

SEQ ID NO: 262 - RNA, 10 nt, Artificial Sequence
  Description of Artificial Sequence: Synthetic oligonucleotide
gagaguragc

SEQ ID NO: 263 - RNA, 10 nt, Artificial Sequence
  Description of Artificial Sequence: Synthetic oligonucleotide
gagagurcgc

SEQ ID NO: 264 - RNA, 10 nt, Artificial Sequence
  Description of Artificial Sequence: Synthetic oligonucleotide
gagagurggc

SEQ ID NO: 265 - RNA, 10 nt, Artificial Sequence
  Description of Artificial Sequence: Synthetic oligonucleotide
gagagurugc

SEQ ID NO: 266 - RNA, 10 nt, Artificial Sequence
  Description of Artificial Sequence: Synthetic oligonucleotide
uagaguragc

SEQ ID NO: 267 - RNA, 10 nt, Artificial Sequence
  Description of Artificial Sequence: Synthetic oligonucleotide
uagagurcgc

SEQ ID NO: 268 - RNA, 10 nt, Artificial Sequence
  Description of Artificial Sequence: Synthetic oligonucleotide
uagagurggc

SEQ ID NO: 269 - RNA, 10 nt, Artificial Sequence
  Description of Artificial Sequence: Synthetic oligonucleotide
uagagurugc

SEQ ID NO: 270 - RNA, 10 nt, Artificial Sequence
  Description of Artificial Sequence: Synthetic oligonucleotide
  modified_base (2)..(2): a, c, u, g, unknown or other
cngaguragc

SEQ ID NO: 271 - RNA, 10 nt, Artificial Sequence
  Description of Artificial Sequence: Synthetic oligonucleotide
  modified_base (2)..(2): a, c, u, g, unknown or other
cngagurcgc

SEQ ID NO: 272 - RNA, 10 nt, Artificial Sequence
  Description of Artificial Sequence: Synthetic oligonucleotide
  modified_base (2)..(2): a, c, u, g, unknown or other
cngagurggc

SEQ ID NO: 273 - RNA, 10 nt, Artificial Sequence
  Description of Artificial Sequence: Synthetic oligonucleotide
  modified_base (2)..(2): a, c, u, g, unknown or other
cngagurugc

SEQ ID NO: 274 - RNA, 10 nt, Artificial Sequence
  Description of Artificial Sequence: Synthetic oligonucleotide
  modified_base (1)..(1): a, c, u, g, unknown or other
ncgaguragc

SEQ ID NO: 275 - RNA, 10 nt, Artificial Sequence
  Description of Artificial Sequence: Synthetic oligonucleotide
  modified_base (1)..(1): a, c, u, g, unknown or other
ncgagurcgc

SEQ ID NO: 276 - RNA, 10 nt, Artificial Sequence
  Description of Artificial Sequence: Synthetic oligonucleotide
  modified_base (1)..(1): a, c, u, g, unknown or other
ncgagurggc

SEQ ID NO: 277 - RNA, 10 nt, Artificial Sequence
  Description of Artificial Sequence: Synthetic oligonucleotide
  modified_base (1)..(1): a, c, u, g, unknown or other
ncgagurugc

SEQ ID NO: 278 - RNA, 10 nt, Artificial Sequence
  Description of Artificial Sequence: Synthetic oligonucleotide
acgaguragc

SEQ ID NO: 279 - RNA, 10 nt, Artificial Sequence
  Description of Artificial Sequence: Synthetic oligonucleotide
acgagurcgc

SEQ ID NO: 280 - RNA, 10 nt, Artificial Sequence
  Description of Artificial Sequence: Synthetic oligonucleotide
acgagurggc

SEQ ID NO: 281 - RNA, 10 nt, Artificial Sequence
  Description of Artificial Sequence: Synthetic oligonucleotide
acgagurugc

SEQ ID NO: 282 - RNA, 10 nt, Artificial Sequence
  Description of Artificial Sequence: Synthetic oligonucleotide
ccgaguragc

SEQ ID NO: 283 - RNA, 10 nt, Artificial Sequence
  Description of Artificial Sequence: Synthetic oligonucleotide
ccgagurcgc

SEQ ID NO: 284 - RNA, 10 nt, Artificial Sequence
  Description of Artificial Sequence: Synthetic oligonucleotide
ccgagurggc

SEQ ID NO: 285 - RNA, 10 nt, Artificial Sequence
  Description of Artificial Sequence: Synthetic oligonucleotide
ccgagurugc

SEQ ID NO: 286 - RNA, 10 nt, Artificial Sequence
  Description of Artificial Sequence: Synthetic oligonucleotide
gcgaguragc

SEQ ID NO: 287 - RNA, 10 nt, Artificial Sequence
  Description of Artificial Sequence: Synthetic oligonucleotide
gcgagurcgc

SEQ ID NO: 288 - RNA, 10 nt, Artificial Sequence
  Description of Artificial Sequence: Synthetic oligonucleotide
gcgagurggc

SEQ ID NO: 289 - RNA, 10 nt, Artificial Sequence
  Description of Artificial Sequence: Synthetic oligonucleotide
gcgagurugc

SEQ ID NO: 290 - RNA, 10 nt, Artificial Sequence
  Description of Artificial Sequence: Synthetic oligonucleotide
ucgaguragc

SEQ ID NO: 291 - RNA, 10 nt, Artificial Sequence
  Description of Artificial Sequence: Synthetic oligonucleotide
ucgagurcgc

SEQ ID NO: 292 - RNA, 10 nt, Artificial Sequence
  Description of Artificial Sequence: Synthetic oligonucleotide
ucgagurggc

SEQ ID NO: 293 - RNA, 10 nt, Artificial Sequence
  Description of Artificial Sequence: Synthetic oligonucleotide
ucgagurugc

SEQ ID NO: 294 - RNA, 10 nt, Artificial Sequence
  Description of Artificial Sequence: Synthetic oligonucleotide
  modified_base (2)..(2): a, c, u, g, unknown or other
gngaguragc

SEQ ID NO: 295 - RNA, 10 nt, Artificial Sequence
  Description of Artificial Sequence: Synthetic oligonucleotide
  modified_base (2)..(2): a, c, u, g, unknown or other
gngagurcgc

SEQ ID NO: 296 - RNA, 10 nt, Artificial Sequence
  Description of Artificial Sequence: Synthetic oligonucleotide
  modified_base (2)..(2): a, c, u, g, unknown or other
gngagurggc

SEQ ID NO: 297 - RNA, 10 nt, Artificial Sequence
  Description of Artificial Sequence: Synthetic oligonucleotide
  modified_base (2)..(2): a, c, u, g, unknown or other
gngagurugc

SEQ ID NO: 298 - RNA, 10 nt, Artificial Sequence
  Description of Artificial Sequence: Synthetic oligonucleotide
  modified_base (1)..(1): a, c, u, g, unknown or other
nggaguragc

SEQ ID NO: 299 - RNA, 10 nt, Artificial Sequence
  Description of Artificial Sequence: Synthetic oligonucleotide
  modified_base (1)..(1): a, c, u, g, unknown or other
nggagurcgc

SEQ ID NO: 300 - RNA, 10 nt, Artificial Sequence
  Description of Artificial Sequence: Synthetic oligonucleotide
  modified_base (1)..(1): a, c, u, g, unknown or other
nggagurggc

SEQ ID NO: 301 - RNA, 10 nt, Artificial Sequence
  Description of Artificial Sequence: Synthetic oligonucleotide
  modified_base (1)..(1): a, c, u, g, unknown or other
nggagurugc

SEQ ID NO: 302 - RNA, 10 nt, Artificial Sequence
  Description of Artificial Sequence: Synthetic oligonucleotide
aggaguragc

SEQ ID NO: 303 - RNA, 10 nt, Artificial Sequence
  Description of Artificial Sequence: Synthetic oligonucleotide
aggagurcgc

SEQ ID NO: 304 - RNA, 10 nt, Artificial Sequence
  Description of Artificial Sequence: Synthetic oligonucleotide
aggagurggc

SEQ ID NO: 305 - RNA, 10 nt, Artificial Sequence
  Description of Artificial Sequence: Synthetic oligonucleotide
aggagurugc

SEQ ID NO: 306 - RNA, 10 nt, Artificial Sequence
  Description of Artificial Sequence: Synthetic oligonucleotide
cggaguragc

SEQ ID NO: 307 - RNA, 10 nt, Artificial Sequence
  Description of Artificial Sequence: Synthetic oligonucleotide
cggagurcgc

SEQ ID NO: 308 - RNA, 10 nt, Artificial Sequence
  Description of Artificial Sequence: Synthetic oligonucleotide
cggagurggc

SEQ ID NO: 309 - RNA, 10 nt, Artificial Sequence
  Description of Artificial Sequence: Synthetic oligonucleotide
cggagurugc

SEQ ID NO: 310 - RNA, 10 nt, Artificial Sequence
  Description of Artificial Sequence: Synthetic oligonucleotide
gggaguragc

SEQ ID NO: 311 - RNA, 10 nt, Artificial Sequence
  Description of Artificial Sequence: Synthetic oligonucleotide
gggagurcgc

SEQ ID NO: 312 - RNA, 10 nt, Artificial Sequence
  Description of Artificial Sequence: Synthetic oligonucleotide
gggagurggc

SEQ ID NO: 313 - RNA, 10 nt, Artificial Sequence
  Description of Artificial Sequence: Synthetic oligonucleotide
gggagurugc

SEQ ID NO: 314 - RNA, 10 nt, Artificial Sequence
  Description of Artificial Sequence: Synthetic oligonucleotide
uggaguragc

SEQ ID NO: 315 - RNA, 10 nt, Artificial Sequence
  Description of Artificial Sequence: Synthetic oligonucleotide
uggagurcgc

SEQ ID NO: 316 - RNA, 10 nt, Artificial Sequence
  Description of Artificial Sequence: Synthetic oligonucleotide
uggagurggc

SEQ ID NO: 317 - RNA, 10 nt, Artificial Sequence
  Description of Artificial Sequence: Synthetic oligonucleotide
uggagurugc

SEQ ID NO: 318 - RNA, 10 nt, Artificial Sequence
  Description of Artificial Sequence: Synthetic oligonucleotide
  modified_base (2)..(2): a, c, u, g, unknown or other
ungaguragc

SEQ ID NO: 319 - RNA, 10 nt, Artificial Sequence
  Description of Artificial Sequence: Synthetic oligonucleotide
  modified_base (2)..(2): a, c, u, g, unknown or other
ungagurcgc

SEQ ID NO: 320 - RNA, 10 nt, Artificial Sequence
  Description of Artificial Sequence: Synthetic oligonucleotide
  modified_base (2)..(2): a, c, u, g, unknown or other
ungagurggc

SEQ ID NO: 321 - RNA, 10 nt, Artificial Sequence
  Description of Artificial Sequence: Synthetic oligonucleotide
  modified_base (2)..(2): a, c, u, g, unknown or other
ungagurugc

SEQ ID NO: 322 - RNA, 10 nt, Artificial Sequence
  Description of Artificial Sequence: Synthetic oligonucleotide
  modified_base (1)..(1): a, c, u, g, unknown or other
nugaguragc

SEQ ID NO: 323 - RNA, 10 nt, Artificial Sequence
  Description of Artificial Sequence: Synthetic oligonucleotide
  modified_base (1)..(1): a, c, u, g, unknown or other
nugagurcgc

SEQ ID NO: 324 - RNA, 10 nt, Artificial Sequence
  Description of Artificial Sequence: Synthetic oligonucleotide
  modified_base (1)..(1): a, c, u, g, unknown or other
nugagurggc

SEQ ID NO: 325 - RNA, 10 nt, Artificial Sequence
  Description of Artificial Sequence: Synthetic oligonucleotide
  modified_base (1)..(1): a, c, u, g, unknown or other
nugagurugc

SEQ ID NO: 326 - RNA, 10 nt, Artificial Sequence
  Description of Artificial Sequence: Synthetic oligonucleotide
augaguragc

SEQ ID NO: 327 - RNA, 10 nt, Artificial Sequence
  Description of Artificial Sequence: Synthetic oligonucleotide
augagurcgc

SEQ ID NO: 328 - RNA, 10 nt, Artificial Sequence
  Description of Artificial Sequence: Synthetic oligonucleotide
augagurggc

SEQ ID NO: 329 - RNA, 10 nt, Artificial Sequence
  Description of Artificial Sequence: Synthetic oligonucleotide
augagurugc

SEQ ID NO: 330 - RNA, 10 nt, Artificial Sequence
  Description of Artificial Sequence: Synthetic oligonucleotide
cugaguragc

SEQ ID NO: 331 - RNA, 10 nt, Artificial Sequence
  Description of Artificial Sequence: Synthetic oligonucleotide
cugagurcgc

SEQ ID NO: 332 - RNA, 10 nt, Artificial Sequence
  Description of Artificial Sequence: Synthetic oligonucleotide
cugagurggc

SEQ ID NO: 333 - RNA, 10 nt, Artificial Sequence
  Description of Artificial Sequence: Synthetic oligonucleotide
cugagurugc

SEQ ID NO: 334 - RNA, 10 nt, Artificial Sequence
  Description of Artificial Sequence: Synthetic oligonucleotide
gugaguragc

SEQ ID NO: 335 - RNA, 10 nt, Artificial Sequence
  Description of Artificial Sequence: Synthetic oligonucleotide
gugagurcgc

SEQ ID NO: 336 - RNA, 10 nt, Artificial Sequence
  Description of Artificial Sequence: Synthetic oligonucleotide
gugagurggc

SEQ ID NO: 337 - RNA, 10 nt, Artificial Sequence
  Description of Artificial Sequence: Synthetic oligonucleotide
gugagurugc

SEQ ID NO: 338 - RNA, 10 nt, Artificial Sequence
  Description of Artificial Sequence: Synthetic oligonucleotide
uugaguragc

SEQ ID NO: 339 - RNA, 10 nt, Artificial Sequence
  Description of Artificial Sequence: Synthetic oligonucleotide
uugagurcgc

SEQ ID NO: 340 - RNA, 10 nt, Artificial Sequence
  Description of Artificial Sequence: Synthetic oligonucleotide
uugagurggc

SEQ ID NO: 341 - RNA, 10 nt, Artificial Sequence
  Description of Artificial Sequence: Synthetic oligonucleotide
uugagurugc

SEQ ID NO: 342 - RNA, 10 nt, Artificial Sequence
  Description of Artificial Sequence: Synthetic oligonucleotide
  modified_base (2)..(2): a, c, u, g, unknown or other
angaguragg

SEQ ID NO: 343 - RNA, 10 nt, Artificial Sequence
  Description of Artificial Sequence: Synthetic oligonucleotide
  modified_base (2)..(2): a, c, u, g, unknown or other
angagurcgg

SEQ ID NO: 344 - RNA, 10 nt, Artificial Sequence
  Description of Artificial Sequence: Synthetic oligonucleotide
  modified_base (2)..(2): a, c, u, g, unknown or other
angagurggg

SEQ ID NO: 345 - RNA, 10 nt, Artificial Sequence
  Description of Artificial Sequence: Synthetic oligonucleotide
  modified_base (2)..(2): a, c, u, g, unknown or other
angagurugg

SEQ ID NO: 346 - RNA, 10 nt, Artificial Sequence
  Description of Artificial Sequence: Synthetic oligonucleotide
  modified_base (1)..(1): a, c, u, g, unknown or other
nagaguragg

SEQ ID NO: 347 - RNA, 10 nt, Artificial Sequence
  Description of Artificial Sequence: Synthetic oligonucleotide
  modified_base (1)..(1): a, c, u, g, unknown or other
nagagurcgg

SEQ ID NO: 348 - RNA, 10 nt, Artificial Sequence
  Description of Artificial Sequence: Synthetic oligonucleotide
  modified_base (1)..(1): a, c, u, g, unknown or other
nagagurggg

SEQ ID NO: 349 - RNA, 10 nt, Artificial Sequence
  Description of Artificial Sequence: Synthetic oligonucleotide
  modified_base (1)..(1): a, c, u, g, unknown or other
nagagurugg

SEQ ID NO: 350 - RNA, 10 nt, Artificial Sequence
  Description of Artificial Sequence: Synthetic oligonucleotide
aagaguragg

SEQ ID NO: 351 - RNA, 10 nt, Artificial Sequence
  Description of Artificial Sequence: Synthetic oligonucleotide
aagagurcgg

SEQ ID NO: 352 - RNA, 10 nt, Artificial Sequence
  Description of Artificial Sequence: Synthetic oligonucleotide
aagagurggg

SEQ ID NO: 353 - RNA, 10 nt, Artificial Sequence
  Description of Artificial Sequence: Synthetic oligonucleotide
aagagurugg

SEQ ID NO: 354 - RNA, 10 nt, Artificial Sequence
  Description of Artificial Sequence: Synthetic oligonucleotide
cagaguragg

SEQ ID NO: 355 - RNA, 10 nt, Artificial Sequence
  Description of Artificial Sequence: Synthetic oligonucleotide
cagagurcgg

SEQ ID NO: 356 - RNA, 10 nt, Artificial Sequence
  Description of Artificial Sequence: Synthetic oligonucleotide
cagagurggg

SEQ ID NO: 357 - RNA, 10 nt, Artificial Sequence
  Description of Artificial Sequence: Synthetic oligonucleotide
cagagurugg

SEQ ID NO: 358 - RNA, 10 nt, Artificial Sequence
  Description of Artificial Sequence: Synthetic oligonucleotide
gagaguragg

SEQ ID NO: 359 - RNA, 10 nt, Artificial Sequence
  Description of Artificial Sequence: Synthetic oligonucleotide
gagagurcgg

SEQ ID NO: 360 - RNA, 10 nt, Artificial Sequence
  Description of Artificial Sequence: Synthetic oligonucleotide
gagagurggg

SEQ ID NO: 361 - RNA, 10 nt, Artificial Sequence
  Description of Artificial Sequence: Synthetic oligonucleotide
gagagurugg

SEQ ID NO: 362 - RNA, 10 nt, Artificial Sequence
  Description of Artificial Sequence: Synthetic oligonucleotide
uagaguragg

SEQ ID NO: 363 - RNA, 10 nt, Artificial Sequence
  Description of Artificial Sequence: Synthetic oligonucleotide
uagagurcgg

SEQ ID NO: 364 - RNA, 10 nt, Artificial Sequence
  Description of Artificial Sequence: Synthetic oligonucleotide
uagagurggg

SEQ ID NO: 365 - RNA, 10 nt, Artificial Sequence
  Description of Artificial Sequence: Synthetic oligonucleotide
uagagurugg

SEQ ID NO: 366 - RNA, 10 nt, Artificial Sequence
  Description of Artificial Sequence: Synthetic oligonucleotide
  modified_base (2)..(2): a, c, u, g, unknown or other
cngaguragg

SEQ ID NO: 367 - RNA, 10 nt, Artificial Sequence
  Description of Artificial Sequence: Synthetic oligonucleotide
  modified_base (2)..(2): a, c, u, g, unknown or other
cngagurcgg

SEQ ID NO: 368 - RNA, 10 nt, Artificial Sequence
  Description of Artificial Sequence: Synthetic oligonucleotide
  modified_base (2)..(2): a, c, u, g, unknown or other
cngagurggg

SEQ ID NO: 369 - RNA, 10 nt, Artificial Sequence
  Description of Artificial Sequence: Synthetic oligonucleotide
  modified_base (2)..(2): a, c, u, g, unknown or other
cngagurugg

SEQ ID NO: 370 - RNA, 10 nt, Artificial Sequence
  Description of Artificial Sequence: Synthetic oligonucleotide
  modified_base (1)..(1): a, c, u, g, unknown or other
ncgaguragg

SEQ ID NO: 371 - RNA, 10 nt, Artificial Sequence
  Description of Artificial Sequence: Synthetic oligonucleotide
  modified_base (1)..(1): a, c, u, g, unknown or other
ncgagurcgg

SEQ ID NO: 372 - RNA, 10 nt, Artificial Sequence
  Description of Artificial Sequence: Synthetic oligonucleotide
  modified_base (1)..(1): a, c, u, g, unknown or other
ncgagurggg

SEQ ID NO: 373 - RNA, 10 nt, Artificial Sequence
  Description of Artificial Sequence: Synthetic oligonucleotide
  modified_base (1)..(1): a, c, u, g, unknown or other
ncgagurugg

SEQ ID NO: 374 - RNA, 10 nt, Artificial Sequence
  Description of Artificial Sequence: Synthetic oligonucleotide
acgaguragg

SEQ ID NO: 375 - RNA, 10 nt, Artificial Sequence
  Description of Artificial Sequence: Synthetic oligonucleotide
acgagurcgg

SEQ ID NO: 376 - RNA, 10 nt, Artificial Sequence
  Description of Artificial Sequence: Synthetic oligonucleotide
acgagurggg

SEQ ID NO: 377 - RNA, 10 nt, Artificial Sequence
  Description of Artificial Sequence: Synthetic oligonucleotide
acgagurugg

SEQ ID NO: 378 - RNA, 10 nt, Artificial Sequence
  Description of Artificial Sequence: Synthetic oligonucleotide
ccgaguragg

SEQ ID NO: 379 - RNA, 10 nt, Artificial Sequence
  Description of Artificial Sequence: Synthetic oligonucleotide
ccgagurcgg

SEQ ID NO: 380 - RNA, 10 nt, Artificial Sequence
  Description of Artificial Sequence: Synthetic oligonucleotide
ccgagurggg

SEQ ID NO: 381 - RNA, 10 nt, Artificial Sequence
  Description of Artificial Sequence: Synthetic oligonucleotide
ccgagurugg

SEQ ID NO: 382 - RNA, 10 nt, Artificial Sequence
  Description of Artificial Sequence: Synthetic oligonucleotide
gcgaguragg

SEQ ID NO: 383 - RNA, 10 nt, Artificial Sequence
  Description of Artificial Sequence: Synthetic oligonucleotide
gcgagurcgg

SEQ ID NO: 384 - RNA, 10 nt, Artificial Sequence
  Description of Artificial Sequence: Synthetic oligonucleotide
gcgagurggg

SEQ ID NO: 385 - RNA, 10 nt, Artificial Sequence
  Description of Artificial Sequence: Synthetic oligonucleotide
gcgagurugg

SEQ ID NO: 386 - RNA, 10 nt, Artificial Sequence
  Description of Artificial Sequence: Synthetic oligonucleotide
ucgaguragg

SEQ ID NO: 387 - RNA, 10 nt, Artificial Sequence
  Description of Artificial Sequence: Synthetic oligonucleotide
ucgagurcgg

SEQ ID NO: 388 - RNA, 10 nt, Artificial Sequence
  Description of Artificial Sequence: Synthetic oligonucleotide
ucgagurggg

SEQ ID NO: 389 - RNA, 10 nt, Artificial Sequence
  Description of Artificial Sequence: Synthetic oligonucleotide
ucgagurugg

SEQ ID NO: 390 - RNA, 10 nt, Artificial Sequence
  Description of Artificial Sequence: Synthetic oligonucleotide
  modified_base (2)..(2): a, c, u, g, unknown or other
gngaguragg

SEQ ID NO: 391 - RNA, 10 nt, Artificial Sequence
  Description of Artificial Sequence: Synthetic oligonucleotide
  modified_base (2)..(2): a, c, u, g, unknown or other
gngagurcgg

SEQ ID NO: 392 - RNA, 10 nt, Artificial Sequence
  Description of Artificial Sequence: Synthetic oligonucleotide
  modified_base (2)..(2): a, c, u, g, unknown or other
gngagurggg

SEQ ID NO: 393 - RNA, 10 nt, Artificial Sequence
  Description of Artificial Sequence: Synthetic oligonucleotide
  modified_base (2)..(2): a, c, u, g, unknown or other
gngagurugg

SEQ ID NO: 394 - RNA, 10 nt, Artificial Sequence
  Description of Artificial Sequence: Synthetic oligonucleotide
  modified_base (1)..(1): a, c, u, g, unknown or other
nggaguragg

SEQ ID NO: 395 - RNA, 10 nt, Artificial Sequence
  Description of Artificial Sequence: Synthetic oligonucleotide
  modified_base (1)..(1): a, c, u, g, unknown or other
nggagurcgg

SEQ ID NO: 396 - RNA, 10 nt, Artificial Sequence
  Description of Artificial Sequence: Synthetic oligonucleotide
  modified_base (1)..(1): a, c, u, g, unknown or other
nggagurggg

SEQ ID NO: 397 - RNA, 10 nt, Artificial Sequence
  Description of Artificial Sequence: Synthetic oligonucleotide
  modified_base (1)..(1): a, c, u, g, unknown or other
nggagurugg

SEQ ID NO: 398 - RNA, 10 nt, Artificial Sequence
  Description of Artificial Sequence: Synthetic oligonucleotide
aggaguragg

SEQ ID NO: 399 - RNA, 10 nt, Artificial Sequence
  Description of Artificial Sequence: Synthetic oligonucleotide
aggagurcgg

SEQ ID NO: 400 - RNA, 10 nt, Artificial Sequence
  Description of Artificial Sequence: Synthetic oligonucleotide
aggagurggg

SEQ ID NO: 401 - RNA, 10 nt, Artificial Sequence
  Description of Artificial Sequence: Synthetic oligonucleotide
aggagurugg

SEQ ID NO: 402 - RNA, 10 nt, Artificial Sequence
  Description of Artificial Sequence: Synthetic oligonucleotide
cggaguragg

SEQ ID NO: 403 - RNA, 10 nt, Artificial Sequence
  Description of Artificial Sequence: Synthetic oligonucleotide
cggagurcgg

SEQ ID NO: 404 - RNA, 10 nt, Artificial Sequence
  Description of Artificial Sequence: Synthetic oligonucleotide
cggagurggg

SEQ ID NO: 405 - RNA, 10 nt, Artificial Sequence
  Description of Artificial Sequence: Synthetic oligonucleotide
cggagurugg

SEQ ID NO: 406 - RNA, 10 nt, Artificial Sequence
  Description of Artificial Sequence: Synthetic oligonucleotide
gggaguragg

SEQ ID NO: 407 - RNA, 10 nt, Artificial Sequence
  Description of Artificial Sequence: Synthetic oligonucleotide
gggagurcgg

SEQ ID NO: 408 - RNA, 10 nt, Artificial Sequence
  Description of Artificial Sequence: Synthetic oligonucleotide
gggagurggg

SEQ ID NO: 409 - RNA, 10 nt, Artificial Sequence
  Description of Artificial Sequence: Synthetic oligonucleotide
gggagurugg

SEQ ID NO: 410 - RNA, 10 nt, Artificial Sequence
  Description of Artificial Sequence: Synthetic oligonucleotide
uggaguragg

SEQ ID NO: 411 - RNA, 10 nt, Artificial Sequence
  Description of Artificial Sequence: Synthetic oligonucleotide
uggagurcgg

SEQ ID NO: 412 - RNA, 10 nt, Artificial Sequence
  Description of Artificial Sequence: Synthetic oligonucleotide
uggagurggg

SEQ ID NO: 413 - RNA, 10 nt, Artificial Sequence
  Description of Artificial Sequence: Synthetic oligonucleotide
uggagurugg

SEQ ID NO: 414 - RNA, 10 nt, Artificial Sequence
  Description of Artificial Sequence: Synthetic oligonucleotide
  modified_base (2)..(2): a, c, u, g, unknown or other
ungaguragg

SEQ ID NO: 415 - RNA, 10 nt, Artificial Sequence
  Description of Artificial Sequence: Synthetic oligonucleotide
  modified_base (2)..(2): a, c, u, g, unknown or other
ungagurcgg

SEQ ID NO: 416 - RNA, 10 nt, Artificial Sequence
  Description of Artificial Sequence: Synthetic oligonucleotide
  modified_base (2)..(2): a, c, u, g, unknown or other
ungagurggg

SEQ ID NO: 417 - RNA, 10 nt, Artificial Sequence
  Description of Artificial Sequence: Synthetic oligonucleotide
  modified_base (2)..(2): a, c, u, g, unknown or other
ungagurugg

SEQ ID NO: 418 - RNA, 10 nt, Artificial Sequence
  Description of Artificial Sequence: Synthetic oligonucleotide
  modified_base (1)..(1): a, c, u, g, unknown or other
nugaguragg

SEQ ID NO: 419 - RNA, 10 nt, Artificial Sequence
  Description of Artificial Sequence: Synthetic oligonucleotide
  modified_base (1)..(1): a, c, u, g, unknown or other
nugagurcgg

SEQ ID NO: 420 - RNA, 10 nt, Artificial Sequence
  Description of Artificial Sequence: Synthetic oligonucleotide
  modified_base (1)..(1): a, c, u, g, unknown or other
nugagurggg

SEQ ID NO: 421 - RNA, 10 nt, Artificial Sequence
  Description of Artificial Sequence: Synthetic oligonucleotide
  modified_base (1)..(1): a, c, u, g, unknown or other
nugagurugg

SEQ ID NO: 422 - RNA, 10 nt, Artificial Sequence
  Description of Artificial Sequence: Synthetic oligonucleotide
augaguragg

SEQ ID NO: 423 - RNA, 10 nt, Artificial Sequence
  Description of Artificial Sequence: Synthetic oligonucleotide
augagurcgg

SEQ ID NO: 424 - RNA, 10 nt, Artificial Sequence
  Description of Artificial Sequence: Synthetic oligonucleotide
augagurggg

SEQ ID NO: 425 - RNA, 10 nt, Artificial Sequence
  Description of Artificial Sequence: Synthetic oligonucleotide
augagurugg

SEQ ID NO: 426 - RNA, 10 nt, Artificial Sequence
  Description of Artificial Sequence: Synthetic oligonucleotide
cugaguragg

SEQ ID NO: 427 - RNA, 10 nt, Artificial Sequence
  Description of Artificial Sequence: Synthetic oligonucleotide
cugagurcgg

SEQ ID NO: 428 - RNA, 10 nt, Artificial Sequence
  Description of Artificial Sequence: Synthetic oligonucleotide
cugagurggg

SEQ ID NO: 429 - RNA, 10 nt, Artificial Sequence
  Description of Artificial Sequence: Synthetic oligonucleotide
cugagurugg

SEQ ID NO: 430 - RNA, 10 nt, Artificial Sequence
  Description of Artificial Sequence: Synthetic oligonucleotide
gugaguragg

SEQ ID NO: 431 - RNA, 10 nt, Artificial Sequence
  Description of Artificial Sequence: Synthetic oligonucleotide
gugagurcgg

SEQ ID NO: 432 - RNA, 10 nt, Artificial Sequence
  Description of Artificial Sequence: Synthetic oligonucleotide
gugagurggg

SEQ ID NO: 433 - RNA, 10 nt, Artificial Sequence
  Description of Artificial Sequence: Synthetic oligonucleotide
gugagurugg

SEQ ID NO: 434 - RNA, 10 nt, Artificial Sequence
  Description of Artificial Sequence: Synthetic oligonucleotide
uugaguragg

SEQ ID NO: 435 - RNA, 10 nt, Artificial Sequence
  Description of Artificial Sequence: Synthetic oligonucleotide
uugagurcgg

SEQ ID NO: 436 - RNA, 10 nt, Artificial Sequence
  Description of Artificial Sequence: Synthetic oligonucleotide
uugagurggg

SEQ ID NO: 437 - RNA, 10 nt, Artificial Sequence
  Description of Artificial Sequence: Synthetic oligonucleotide
uugagurugg

SEQ ID NO: 438 - RNA, 10 nt, Artificial Sequence
  Description of Artificial Sequence: Synthetic oligonucleotide
  modified_base (2)..(2): a, c, u, g, unknown or other
angagurcgu

SEQ ID NO: 439 - RNA, 10 nt, Artificial Sequence
  Description of Artificial Sequence: Synthetic oligonucleotide
  modified_base (2)..(2): a, c, u, g, unknown or other
angagurggu

SEQ ID NO: 440 - RNA, 10 nt, Artificial Sequence
  Description of Artificial Sequence: Synthetic oligonucleotide
  modified_base (2)..(2): a, c, u, g, unknown or other
angagurugu

SEQ ID NO: 441 - RNA, 10 nt, Artificial Sequence
  Description of Artificial Sequence: Synthetic oligonucleotide
  modified_base (1)..(1): a, c, u, g, unknown or other
nagagurcgu

SEQ ID NO: 442 - RNA, 10 nt, Artificial Sequence
  Description of Artificial Sequence: Synthetic oligonucleotide
  modified_base (1)..(1): a, c, u, g, unknown or other
nagagurggu

SEQ ID NO: 443 - RNA, 10 nt, Artificial Sequence
  Description of Artificial Sequence: Synthetic oligonucleotide
  modified_base (1)..(1): a, c, u, g, unknown or other
nagagurugu

SEQ ID NO: 444 - RNA, 10 nt, Artificial Sequence
  Description of Artificial Sequence: Synthetic oligonucleotide
aagagurcgu

SEQ ID NO: 445 - RNA, 10 nt, Artificial Sequence
  Description of Artificial Sequence: Synthetic oligonucleotide
aagagurggu

SEQ ID NO: 446 - RNA, 10 nt, Artificial Sequence
  Description of Artificial Sequence: Synthetic oligonucleotide
aagagurugu

SEQ ID NO: 447 - RNA, 10 nt, Artificial Sequence
  Description of Artificial Sequence: Synthetic oligonucleotide
cagagurcgu

SEQ ID NO: 448 - RNA, 10 nt, Artificial Sequence
  Description of Artificial Sequence: Synthetic oligonucleotide
cagagurggu

SEQ ID NO: 449 - RNA, 10 nt, Artificial Sequence
  Description of Artificial Sequence: Synthetic oligonucleotide
cagagurugu

SEQ ID NO: 450 - RNA, 10 nt, Artificial Sequence
  Description of Artificial Sequence: Synthetic oligonucleotide
gagagurcgu

SEQ ID NO: 451 - RNA, 10 nt, Artificial Sequence
  Description of Artificial Sequence: Synthetic oligonucleotide
gagagurggu

SEQ ID NO: 452 - RNA, 10 nt, Artificial Sequence
  Description of Artificial Sequence: Synthetic oligonucleotide
gagagurugu

SEQ ID NO: 453 - RNA, 10 nt, Artificial Sequence
  Description of Artificial Sequence: Synthetic oligonucleotide
uagagurcgu

SEQ ID NO: 454 - RNA, 10 nt, Artificial Sequence
  Description of Artificial Sequence: Synthetic oligonucleotide
uagagurggu

SEQ ID NO: 455 - RNA, 10 nt, Artificial Sequence
  Description of Artificial Sequence: Synthetic oligonucleotide
uagagurugu

SEQ ID NO: 456 - RNA, 10 nt, Artificial Sequence
  Description of Artificial Sequence: Synthetic oligonucleotide
  modified_base (2)..(2): a, c, u, g, unknown or other
cngagurcgu

SEQ ID NO: 457 - RNA, 10 nt, Artificial Sequence
  Description of Artificial Sequence: Synthetic oligonucleotide
  modified_base (2)..(2): a, c, u, g, unknown or other
cngagurggu

SEQ ID NO: 458 - RNA, 10 nt, Artificial Sequence
  Description of Artificial Sequence: Synthetic oligonucleotide
  modified_base (2)..(2): a, c, u, g, unknown or other
cngagurugu

SEQ ID NO: 459 - RNA, 10 nt, Artificial Sequence
  Description of Artificial Sequence: Synthetic oligonucleotide
  modified_base (1)..(1): a, c, u, g, unknown or other
ncgagurcgu

SEQ ID NO: 460 - RNA, 10 nt, Artificial Sequence
  Description of Artificial Sequence: Synthetic oligonucleotide
  modified_base (1)..(1): a, c, u, g, unknown or other
ncgagurggu

SEQ ID NO: 461 - RNA, 10 nt, Artificial Sequence
  Description of Artificial Sequence: Synthetic oligonucleotide
  modified_base (1)..(1): a, c, u, g, unknown or other
ncgagurugu

SEQ ID NO: 462 - RNA, 10 nt, Artificial Sequence
  Description of Artificial Sequence: Synthetic oligonucleotide
acgagurcgu

SEQ ID NO: 463 - RNA, 10 nt, Artificial Sequence
  Description of Artificial Sequence: Synthetic oligonucleotide
acgagurggu

SEQ ID NO: 464 - RNA, 10 nt, Artificial Sequence
  Description of Artificial Sequence: Synthetic oligonucleotide
acgagurugu

SEQ ID NO: 465 - RNA, 10 nt, Artificial Sequence
  Description of Artificial Sequence: Synthetic oligonucleotide
ccgagurcgu

SEQ ID NO: 466 - RNA, 10 nt, Artificial Sequence
  Description of Artificial Sequence: Synthetic oligonucleotide
ccgagurggu

SEQ ID NO: 467 - RNA, 10 nt, Artificial Sequence
  Description of Artificial Sequence: Synthetic oligonucleotide
ccgagurugu

SEQ ID NO: 468 - RNA, 10 nt, Artificial Sequence
  Description of Artificial Sequence: Synthetic oligonucleotide
gcgagurcgu

SEQ ID NO: 469 - RNA, 10 nt, Artificial Sequence
  Description of Artificial Sequence: Synthetic oligonucleotide
gcgagurggu

SEQ ID NO: 470 - RNA, 10 nt, Artificial Sequence
  Description of Artificial Sequence: Synthetic oligonucleotide
gcgagurugu

SEQ ID NO: 471 - RNA, 10 nt, Artificial Sequence
  Description of Artificial Sequence: Synthetic oligonucleotide
ucgagurcgu

SEQ ID NO: 472 - RNA, 10 nt, Artificial Sequence
  Description of Artificial Sequence: Synthetic oligonucleotide
ucgagurggu

SEQ ID NO: 473 - RNA, 10 nt, Artificial Sequence
  Description of Artificial Sequence: Synthetic oligonucleotide
ucgagurugu

SEQ ID NO: 474 - RNA, 10 nt, Artificial Sequence
  Description of Artificial Sequence: Synthetic oligonucleotide
  modified_base (2)..(2): a, c, u, g, unknown or other
gngagurcgu

SEQ ID NO: 475 - RNA, 10 nt, Artificial Sequence
  Description of Artificial Sequence: Synthetic oligonucleotide
  modified_base (2)..(2): a, c, u, g, unknown or other
gngagurggu

SEQ ID NO: 476 - RNA, 10 nt, Artificial Sequence
  Description of Artificial Sequence: Synthetic oligonucleotide
  modified_base (2)..(2): a, c, u, g, unknown or other
gngagurugu

SEQ ID NO: 477 - RNA, 10 nt, Artificial Sequence
  Description of Artificial Sequence: Synthetic oligonucleotide
  modified_base (1)..(1): a, c, u, g, unknown or other
nggagurcgu

SEQ ID NO: 478 - RNA, 10 nt, Artificial Sequence
  Description of Artificial Sequence: Synthetic oligonucleotide
  modified_base (1)..(1): a, c, u, g, unknown or other
nggagurggu

SEQ ID NO: 479 - RNA, 10 nt, Artificial Sequence
  Description of Artificial Sequence: Synthetic oligonucleotide
  modified_base (1)..(1): a, c, u, g, unknown or other
nggagurugu

SEQ ID NO: 480 - RNA, 10 nt, Artificial Sequence
  Description of Artificial Sequence: Synthetic oligonucleotide
aggagurcgu

SEQ ID NO: 481 - RNA, 10 nt, Artificial Sequence
  Description of Artificial Sequence: Synthetic oligonucleotide
aggagurggu

SEQ ID NO: 482 - RNA, 10 nt, Artificial Sequence
  Description of Artificial Sequence: Synthetic oligonucleotide
aggagurugu

SEQ ID NO: 483 - RNA, 10 nt, Artificial Sequence
  Description of Artificial Sequence: Synthetic oligonucleotide
cggagurcgu

SEQ ID NO: 484 - RNA, 10 nt, Artificial Sequence
  Description of Artificial Sequence: Synthetic oligonucleotide
cggagurggu

SEQ ID NO: 485 - RNA, 10 nt, Artificial Sequence
  Description of Artificial Sequence: Synthetic oligonucleotide
cggagurugu

SEQ ID NO: 486 - RNA, 10 nt, Artificial Sequence
  Description of Artificial Sequence: Synthetic oligonucleotide
gggagurcgu

SEQ ID NO: 487 - RNA, 10 nt, Artificial Sequence
  Description of Artificial Sequence: Synthetic oligonucleotide
gggagurggu

SEQ ID NO: 488 - RNA, 10 nt, Artificial Sequence
  Description of Artificial Sequence: Synthetic oligonucleotide
gggagurugu

SEQ ID NO: 489 - RNA, 10 nt, Artificial Sequence
  Description of Artificial Sequence: Synthetic oligonucleotide
uggaguragu

SEQ ID NO: 490 - RNA, 10 nt, Artificial Sequence
  Description of Artificial Sequence: Synthetic oligonucleotide
uggagurcgu

SEQ ID NO: 491 - RNA, 10 nt, Artificial Sequence
  Description of Artificial Sequence: Synthetic oligonucleotide
uggagurggu

SEQ ID NO: 492 - RNA, 10 nt, Artificial Sequence
  Description of Artificial Sequence: Synthetic oligonucleotide
uggagurugu

SEQ ID NO: 493 - RNA, 10 nt, Artificial Sequence
  Description of Artificial Sequence: Synthetic oligonucleotide
  modified_base (2)..(2): a, c, u, g, unknown or other
ungagurcgu

SEQ ID NO: 494 - RNA, 10 nt, Artificial Sequence
  Description of Artificial Sequence: Synthetic oligonucleotide
  modified_base (2)..(2): a, c, u, g, unknown or other
ungagurggu

SEQ ID NO: 495 - RNA, 10 nt, Artificial Sequence
  Description of Artificial Sequence: Synthetic oligonucleotide
  modified_base (2)..(2): a, c, u, g, unknown or other
ungagurugu

SEQ ID NO: 496 - RNA, 10 nt, Artificial Sequence
  Description of Artificial Sequence: Synthetic oligonucleotide
  modified_base (1)..(1): a, c, u, g, unknown or other
nugagurcgu

SEQ ID NO: 497 - RNA, 10 nt, Artificial Sequence
  Description of Artificial Sequence: Synthetic oligonucleotide
  modified_base (1)..(1): a, c, u, g, unknown or other
nugagurggu

SEQ ID NO: 498 - RNA, 10 nt, Artificial Sequence
  Description of Artificial Sequence: Synthetic oligonucleotide
  modified_base (1)..(1): a, c, u, g, unknown or other
nugagurugu

SEQ ID NO: 499 - RNA, 10 nt, Artificial Sequence
  Description of Artificial Sequence: Synthetic oligonucleotide
augagurcgu

SEQ ID NO: 500 - RNA, 10 nt, Artificial Sequence
  Description of Artificial Sequence: Synthetic oligonucleotide
augagurggu

SEQ ID NO: 501 - RNA, 10 nt, Artificial Sequence
  Description of Artificial Sequence: Synthetic oligonucleotide
augagurugu

SEQ ID NO: 502 - RNA, 10 nt, Artificial Sequence
  Description of Artificial Sequence: Synthetic oligonucleotide
cugagurcgu

SEQ ID NO: 503 - RNA, 10 nt, Artificial Sequence
  Description of Artificial Sequence: Synthetic oligonucleotide
cugagurggu

SEQ ID NO: 504 - RNA, 10 nt, Artificial Sequence
  Description of Artificial Sequence: Synthetic oligonucleotide
cugagurugu

SEQ ID NO: 505 - RNA, 10 nt, Artificial Sequence
  Description of Artificial Sequence: Synthetic oligonucleotide
gugagurcgu

SEQ ID NO: 506 - RNA, 10 nt, Artificial Sequence
  Description of Artificial Sequence: Synthetic oligonucleotide
gugagurggu

SEQ ID NO: 507 - RNA, 10 nt, Artificial Sequence
  Description of Artificial Sequence: Synthetic oligonucleotide
gugagurugu

SEQ ID NO: 508 - RNA, 10 nt, Artificial Sequence
  Description of Artificial Sequence: Synthetic oligonucleotide
uugaguragu

SEQ ID NO: 509 - RNA, 10 nt, Artificial Sequence
  Description of Artificial Sequence: Synthetic oligonucleotide
uugagurcgu

SEQ ID NO: 510 - RNA, 10 nt, Artificial Sequence
  Description of Artificial Sequence: Synthetic oligonucleotide
uugagurggu

SEQ ID NO: 511 - RNA, 10 nt, Artificial Sequence
  Description of Artificial Sequence: Synthetic oligonucleotide
uugagurugu

SEQ ID NO: 512 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
angagurnga

SEQ ID NO: 513 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
angagurngc

SEQ ID NO: 514 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
angagurngg

SEQ ID NO: 515 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
angagurngu

SEQ ID NO: 516 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
nagagurnga

SEQ ID NO: 517 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
nagagurngc

SEQ ID NO: 518 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
nagagurngg

SEQ ID NO: 519 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
nagagurngu

SEQ ID NO: 520 - RNA, 10 nt, Artificial Sequence
  Description of Artificial Sequence: Synthetic oligonucleotide
  modified_base (8)..(8): a, c, u, g, unknown or other
aagagurnga

SEQ ID NO: 521 - RNA, 10 nt, Artificial Sequence
  Description of Artificial Sequence: Synthetic oligonucleotide
  modified_base (8)..(8): a, c, u, g, unknown or other
aagagurngc

SEQ ID NO: 522 - RNA, 10 nt, Artificial Sequence
  Description of Artificial Sequence: Synthetic oligonucleotide
  modified_base (8)..(8): a, c, u, g, unknown or other
aagagurngg

SEQ ID NO: 523 - RNA, 10 nt, Artificial Sequence
  Description of Artificial Sequence: Synthetic oligonucleotide
  modified_base (8)..(8): a, c, u, g, unknown or other
aagagurngu

SEQ ID NO: 524 - RNA, 10 nt, Artificial Sequence
  Description of Artificial Sequence: Synthetic oligonucleotide
  modified_base (8)..(8): a, c, u, g, unknown or other
cagagurnga

SEQ ID NO: 525 - RNA, 10 nt, Artificial Sequence
  Description of Artificial Sequence: Synthetic oligonucleotide
  modified_base (8)..(8): a, c, u, g, unknown or other
cagagurngc

SEQ ID NO: 526 - RNA, 10 nt, Artificial Sequence
  Description of Artificial Sequence: Synthetic oligonucleotide
  modified_base (8)..(8): a, c, u, g, unknown or other
cagagurngg

SEQ ID NO: 527 - RNA, 10 nt, Artificial Sequence
  Description of Artificial Sequence: Synthetic oligonucleotide
  modified_base (8)..(8): a, c, u, g, unknown or other
cagagurngu

SEQ ID NO: 528 - RNA, 10 nt, Artificial Sequence
  Description of Artificial Sequence: Synthetic oligonucleotide
  modified_base (8)..(8): a, c, u, g, unknown or other
gagagurnga

SEQ ID NO: 529 - RNA, 10 nt, Artificial Sequence
  Description of Artificial Sequence: Synthetic oligonucleotide
  modified_base (8)..(8): a, c, u, g, unknown or other
gagagurngc

SEQ ID NO: 530 - RNA, 10 nt, Artificial Sequence
  Description of Artificial Sequence: Synthetic oligonucleotide
  modified_base (8)..(8): a, c, u, g, unknown or other
gagagurngg

SEQ ID NO: 531 - RNA, 10 nt, Artificial Sequence
  Description of Artificial Sequence: Synthetic oligonucleotide
  modified_base (8)..(8): a, c, u, g, unknown or other
gagagurngu

SEQ ID NO: 532 - RNA, 10 nt, Artificial Sequence
  Description of Artificial Sequence: Synthetic oligonucleotide
  modified_base (8)..(8): a, c, u, g, unknown or other
uagagurnga

SEQ ID NO: 533 - RNA, 10 nt, Artificial Sequence
  Description of Artificial Sequence: Synthetic oligonucleotide
  modified_base (8)..(8): a, c, u, g, unknown or other
uagagurngc

SEQ ID NO: 534 - RNA, 10 nt, Artificial Sequence
  Description of Artificial Sequence: Synthetic oligonucleotide
  modified_base (8)..(8): a, c, u, g, unknown or other
uagagurngg

SEQ ID NO: 535 - RNA, 10 nt, Artificial Sequence
  Description of Artificial Sequence: Synthetic oligonucleotide
  modified_base (8)..(8): a, c, u, g, unknown or other
uagagurngu

SEQ ID NO: 536 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
cngagurnga

SEQ ID NO: 537 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
cngagurngc

SEQ ID NO: 538 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
cngagurngg

SEQ ID NO: 539 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
cngagurngu

SEQ ID NO: 540 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
ncgagurnga

SEQ ID NO: 541 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
ncgagurngc

SEQ ID NO: 542 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
ncgagurngg

SEQ ID NO: 543 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
ncgagurngu

SEQ ID NO: 544 - RNA, 10 nt, Artificial Sequence
  Description of Artificial Sequence: Synthetic oligonucleotide
  modified_base (8)..(8): a, c, u, g, unknown or other
acgagurnga

SEQ ID NO: 545 - RNA, 10 nt, Artificial Sequence
  Description of Artificial Sequence: Synthetic oligonucleotide
  modified_base (8)..(8): a, c, u, g, unknown or other
acgagurngc

SEQ ID NO: 546 - RNA, 10 nt, Artificial Sequence
  Description of Artificial Sequence: Synthetic oligonucleotide
  modified_base (8)..(8): a, c, u, g, unknown or other
acgagurngg

SEQ ID NO: 547 - RNA, 10 nt, Artificial Sequence
  Description of Artificial Sequence: Synthetic oligonucleotide
  modified_base (8)..(8): a, c, u, g, unknown or other
acgagurngu

SEQ ID NO: 548 - RNA, 10 nt, Artificial Sequence
  Description of Artificial Sequence: Synthetic oligonucleotide
  modified_base (8)..(8): a, c, u, g, unknown or other
ccgagurnga

SEQ ID NO: 549 - RNA, 10 nt, Artificial Sequence
  Description of Artificial Sequence: Synthetic oligonucleotide
  modified_base (8)..(8): a, c, u, g, unknown or other
ccgagurngc

SEQ ID NO: 550 - RNA, 10 nt, Artificial Sequence
  Description of Artificial Sequence: Synthetic oligonucleotide
  modified_base (8)..(8): a, c, u, g, unknown or other
ccgagurngg

SEQ ID NO: 551 - RNA, 10 nt, Artificial Sequence
  Description of Artificial Sequence: Synthetic oligonucleotide
  modified_base (8)..(8): a, c, u, g, unknown or other
ccgagurngu

SEQ ID NO: 552 - RNA, 10 nt, Artificial Sequence
  Description of Artificial Sequence: Synthetic oligonucleotide
  modified_base (8)..(8): a, c, u, g, unknown or other
gcgagurnga

SEQ ID NO: 553 - RNA, 10 nt, Artificial Sequence
  Description of Artificial Sequence: Synthetic oligonucleotide
  modified_base (8)..(8): a, c, u, g, unknown or other
gcgagurngc

SEQ ID NO: 554 - RNA, 10 nt, Artificial Sequence
  Description of Artificial Sequence: Synthetic oligonucleotide
  modified_base (8)..(8): a, c, u, g, unknown or other
gcgagurngg

SEQ ID NO: 555 - RNA, 10 nt, Artificial Sequence
  Description of Artificial Sequence: Synthetic oligonucleotide
  modified_base (8)..(8): a, c, u, g, unknown or other
gcgagurngu

SEQ ID NO: 556 - RNA, 10 nt, Artificial Sequence
  Description of Artificial Sequence: Synthetic oligonucleotide
  modified_base (8)..(8): a, c, u, g, unknown or other
ucgagurnga

SEQ ID NO: 557 - RNA, 10 nt, Artificial Sequence
  Description of Artificial Sequence: Synthetic oligonucleotide
  modified_base (8)..(8): a, c, u, g, unknown or other
ucgagurngc

SEQ ID NO: 558 - RNA, 10 nt, Artificial Sequence
  Description of Artificial Sequence: Synthetic oligonucleotide
  modified_base (8)..(8): a, c, u, g, unknown or other
ucgagurngg

SEQ ID NO: 559 - RNA, 10 nt, Artificial Sequence
  Description of Artificial Sequence: Synthetic oligonucleotide
  modified_base (8)..(8): a, c, u, g, unknown or other
ucgagurngu

SEQ ID NO: 560 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
gngagurnga

SEQ ID NO: 561 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
gngagurngc

SEQ ID NO: 562 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
gngagurngg

SEQ ID NO: 563 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
gngagurngu

SEQ ID NO: 564 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
nggagurnga

SEQ ID NO: 565 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
nggagurngc

SEQ ID NO: 566 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
nggagurngg

SEQ ID NO: 567 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
nggagurngu

SEQ ID NO: 568 - RNA, 10 nt, Artificial Sequence
  Description of Artificial Sequence: Synthetic oligonucleotide
  modified_base (8)..(8): a, c, u, g, unknown or other
aggagurnga

SEQ ID NO: 569 - RNA, 10 nt, Artificial Sequence
  Description of Artificial Sequence: Synthetic oligonucleotide
  modified_base (8)..(8): a, c, u, g, unknown or other
aggagurngc

SEQ ID NO: 570 - RNA, 10 nt, Artificial Sequence
  Description of Artificial Sequence: Synthetic oligonucleotide
  modified_base (8)..(8): a, c, u, g, unknown or other
aggagurngg

SEQ ID NO: 571 - RNA, 10 nt, Artificial Sequence
  Description of Artificial Sequence: Synthetic oligonucleotide
  modified_base (8)..(8): a, c, u, g, unknown or other
aggagurngu

SEQ ID NO: 572 - RNA, 10 nt, Artificial Sequence
  Description of Artificial Sequence: Synthetic oligonucleotide
  modified_base (8)..(8): a, c, u, g, unknown or other
cggagurnga

SEQ ID NO: 573 - RNA, 10 nt, Artificial Sequence
  Description of Artificial Sequence: Synthetic oligonucleotide
  modified_base (8)..(8): a, c, u, g, unknown or other
cggagurngc

SEQ ID NO: 574 - RNA, 10 nt, Artificial Sequence
  Description of Artificial Sequence: Synthetic oligonucleotide
  modified_base (8)..(8): a, c, u, g, unknown or other
cggagurngg

SEQ ID NO: 575 - RNA, 10 nt, Artificial Sequence
  Description of Artificial Sequence: Synthetic oligonucleotide
  modified_base (8)..(8): a, c, u, g, unknown or other
cggagurngu

SEQ ID NO: 576 - RNA, 10 nt, Artificial Sequence
  Description of Artificial Sequence: Synthetic oligonucleotide
  modified_base (8)..(8): a, c, u, g, unknown or other
gggagurnga

SEQ ID NO: 577 - RNA, 10 nt, Artificial Sequence
  Description of Artificial Sequence: Synthetic oligonucleotide
  modified_base (8)..(8): a, c, u, g, unknown or other
gggagurngc

SEQ ID NO: 578 - RNA, 10 nt, Artificial Sequence
  Description of Artificial Sequence: Synthetic oligonucleotide
  modified_base (8)..(8): a, c, u, g, unknown or other
gggagurngg

SEQ ID NO: 579 - RNA, 10 nt, Artificial Sequence
  Description of Artificial Sequence: Synthetic oligonucleotide
  modified_base (8)..(8): a, c, u, g, unknown or other
gggagurngu

SEQ ID NO: 580 - RNA, 10 nt, Artificial Sequence
  Description of Artificial Sequence: Synthetic oligonucleotide
  modified_base (8)..(8): a, c, u, g, unknown or other
uggagurnga

SEQ ID NO: 581 - RNA, 10 nt, Artificial Sequence
  Description of Artificial Sequence: Synthetic oligonucleotide
  modified_base (8)..(8): a, c, u, g, unknown or other
uggagurngc

SEQ ID NO: 582 - RNA, 10 nt, Artificial Sequence
  Description of Artificial Sequence: Synthetic oligonucleotide
  modified_base (8)..(8): a, c, u, g, unknown or other
uggagurngg

SEQ ID NO: 583 - RNA, 10 nt, Artificial Sequence
  Description of Artificial Sequence: Synthetic oligonucleotide
  modified_base (8)..(8): a, c, u, g, unknown or other
uggagurngu

SEQ ID NO: 584 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
ungagurnga

SEQ ID NO: 585 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
ungagurngc

SEQ ID NO: 586 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
ungagurngg

SEQ ID NO: 587 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
ungagurngu

SEQ ID NO: 588 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
nugagurnga

SEQ ID NO: 589 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
nugagurngc

SEQ ID NO: 590 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
nugagurngg

SEQ ID NO: 591 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
nugagurngu

SEQ ID NO: 592 - RNA, 10 nt, Artificial Sequence
  Description of Artificial Sequence: Synthetic oligonucleotide
  modified_base (8)..(8): a, c, u, g, unknown or other
augagurnga

SEQ ID NO: 593 - RNA, 10 nt, Artificial Sequence
  Description of Artificial Sequence: Synthetic oligonucleotide
  modified_base (8)..(8): a, c, u, g, unknown or other
augagurngc

SEQ ID NO: 594 - RNA, 10 nt, Artificial Sequence
  Description of Artificial Sequence: Synthetic oligonucleotide
  modified_base (8)..(8): a, c, u, g, unknown or other
augagurngg

SEQ ID NO: 595 - RNA, 10 nt, Artificial Sequence
  Description of Artificial Sequence: Synthetic oligonucleotide
  modified_base (8)..(8): a, c, u, g, unknown or other
augagurngu

SEQ ID NO: 596 - RNA, 10 nt, Artificial Sequence
  Description of Artificial Sequence: Synthetic oligonucleotide
  modified_base (8)..(8): a, c, u, g, unknown or other
cugagurnga

SEQ ID NO: 597 - RNA, 10 nt, Artificial Sequence
  Description of Artificial Sequence: Synthetic oligonucleotide
  modified_base (8)..(8): a, c, u, g, unknown or other
cugagurngc

SEQ ID NO: 598 - RNA, 10 nt, Artificial Sequence
  Description of Artificial Sequence: Synthetic oligonucleotide
  modified_base (8)..(8): a, c, u, g, unknown or other
cugagurngg

SEQ ID NO: 599 - RNA, 10 nt, Artificial Sequence
  Description of Artificial Sequence: Synthetic oligonucleotide
  modified_base (8)..(8): a, c, u, g, unknown or other
cugagurngu

SEQ ID NO: 600 - RNA, 10 nt, Artificial Sequence
  Description of Artificial Sequence: Synthetic oligonucleotide
  modified_base (8)..(8): a, c, u, g, unknown or other
gugagurnga

SEQ ID NO: 601 - RNA, 10 nt, Artificial Sequence
  Description of Artificial Sequence: Synthetic oligonucleotide
  modified_base (8)..(8): a, c, u, g, unknown or other
gugagurngc

SEQ ID NO: 602 - RNA, 10 nt, Artificial Sequence
  Description of Artificial Sequence: Synthetic oligonucleotide
  modified_base (8)..(8): a, c, u, g, unknown or other
gugagurngg

SEQ ID NO: 603 - RNA, 10 nt, Artificial Sequence
  Description of Artificial Sequence: Synthetic oligonucleotide
  modified_base (8)..(8): a, c, u, g, unknown or other
gugagurngu

SEQ ID NO: 604 - RNA, 10 nt, Artificial Sequence
  Description of Artificial Sequence: Synthetic oligonucleotide
  modified_base (8)..(8): a, c, u, g, unknown or other
uugagurnga

SEQ ID NO: 605 - RNA, 10 nt, Artificial Sequence
  Description of Artificial Sequence: Synthetic oligonucleotide
  modified_base (8)..(8): a, c, u, g, unknown or other
uugagurngc

SEQ ID NO: 606 - RNA, 10 nt, Artificial Sequence
  Description of Artificial Sequence: Synthetic oligonucleotide
  modified_base (8)..(8): a, c, u, g, unknown or other
uugagurngg

SEQ ID NO: 607 - RNA, 10 nt, Artificial Sequence
  Description of Artificial Sequence: Synthetic oligonucleotide
  modified_base (8)..(8): a, c, u, g, unknown or other
uugagurngu

SEQ ID NO: 608 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
  modified_base (10)..(10): a, c, u, g, unknown or other
angaguangn

SEQ ID NO: 609 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
angaguaagn

SEQ ID NO: 610 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
angaguacgn

SEQ ID NO: 611 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
angaguaggn

SEQ ID NO: 612 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
  modified_base (10)..(10): a, c, u, g, unknown or other
nagaguangn

SEQ ID NO: 613 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
nagaguaagn

SEQ ID NO: 614 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
nagaguacgn

SEQ ID NO: 615 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
nagaguaggn

SEQ ID NO: 616 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
aagaguangn

SEQ ID NO: 617 - RNA, 10 nt, Artificial Sequence
  Description of Artificial Sequence: Synthetic oligonucleotide
  modified_base (10)..(10): a, c, u, g, unknown or other
aagaguaagn

SEQ ID NO: 618 - RNA, 10 nt, Artificial Sequence
  Description of Artificial Sequence: Synthetic oligonucleotide
  modified_base (10)..(10): a, c, u, g, unknown or other
aagaguacgn

SEQ ID NO: 619 - RNA, 10 nt, Artificial Sequence
  Description of Artificial Sequence: Synthetic oligonucleotide
  modified_base (10)..(10): a, c, u, g, unknown or other
aagaguaggn

SEQ ID NO: 620 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
cagaguangn

SEQ ID NO: 621 - RNA, 10 nt, Artificial Sequence
  Description of Artificial Sequence: Synthetic oligonucleotide
  modified_base (10)..(10): a, c, u, g, unknown or other
cagaguaagn

SEQ ID NO: 622 - RNA, 10 nt, Artificial Sequence
  Description of Artificial Sequence: Synthetic oligonucleotide
  modified_base (10)..(10): a, c, u, g, unknown or other
cagaguacgn

SEQ ID NO: 623 - RNA, 10 nt, Artificial Sequence
  Description of Artificial Sequence: Synthetic oligonucleotide
  modified_base (10)..(10): a, c, u, g, unknown or other
cagaguaggn

SEQ ID NO: 624 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
gagaguangn

SEQ ID NO: 625 - RNA, 10 nt, Artificial Sequence
  Description of Artificial Sequence: Synthetic oligonucleotide
  modified_base (10)..(10): a, c, u, g, unknown or other
gagaguaagn

SEQ ID NO: 626 - RNA, 10 nt, Artificial Sequence
  Description of Artificial Sequence: Synthetic oligonucleotide
  modified_base (10)..(10): a, c, u, g, unknown or other
gagaguacgn

SEQ ID NO: 627 - RNA, 10 nt, Artificial Sequence
  Description of Artificial Sequence: Synthetic oligonucleotide
  modified_base (10)..(10): a, c, u, g, unknown or other
gagaguaggn

SEQ ID NO: 628 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
uagaguangn

SEQ ID NO: 629 - RNA, 10 nt, Artificial Sequence
  Description of Artificial Sequence: Synthetic oligonucleotide
  modified_base (10)..(10): a, c, u, g, unknown or other
uagaguaagn

SEQ ID NO: 630 - RNA, 10 nt, Artificial Sequence
  Description of Artificial Sequence: Synthetic oligonucleotide
  modified_base (10)..(10): a, c, u, g, unknown or other
uagaguacgn

SEQ ID NO: 631 - RNA, 10 nt, Artificial Sequence
  Description of Artificial Sequence: Synthetic oligonucleotide
  modified_base (10)..(10): a, c, u, g, unknown or other
uagaguaggn

SEQ ID NO: 632 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
  modified_base (10)..(10): a, c, u, g, unknown or other
cngaguangn

SEQ ID NO: 633 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
cngaguaagn

SEQ ID NO: 634 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
cngaguacgn

SEQ ID NO: 635 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
cngaguaggn

SEQ ID NO: 636 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
  modified_base (10)..(10): a, c, u, g, unknown or other
ncgaguangn

SEQ ID NO: 637 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
ncgaguaagn

SEQ ID NO: 638 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
ncgaguacgn

SEQ ID NO: 639 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
ncgaguaggn

SEQ ID NO: 640 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
acgaguangn

SEQ ID NO: 641 - RNA, 10 nt, Artificial Sequence
  Description of Artificial Sequence: Synthetic oligonucleotide
  modified_base (10)..(10): a, c, u, g, unknown or other
acgaguaagn

SEQ ID NO: 642 - RNA, 10 nt, Artificial Sequence
  Description of Artificial Sequence: Synthetic oligonucleotide
  modified_base (10)..(10): a, c, u, g, unknown or other
acgaguacgn

SEQ ID NO: 643 - RNA, 10 nt, Artificial Sequence
  Description of Artificial Sequence: Synthetic oligonucleotide
  modified_base (10)..(10): a, c, u, g, unknown or other
acgaguaggn

SEQ ID NO: 644 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
ccgaguangn

SEQ ID NO: 645 - RNA, 10 nt, Artificial Sequence
  Description of Artificial Sequence: Synthetic oligonucleotide
  modified_base (10)..(10): a, c, u, g, unknown or other
ccgaguaagn

SEQ ID NO: 646 - RNA, 10 nt, Artificial Sequence
  Description of Artificial Sequence: Synthetic oligonucleotide
  modified_base (10)..(10): a, c, u, g, unknown or other
ccgaguacgn

SEQ ID NO: 647 - RNA, 10 nt, Artificial Sequence
  Description of Artificial Sequence: Synthetic oligonucleotide
  modified_base (10)..(10): a, c, u, g, unknown or other
ccgaguaggn

SEQ ID NO: 648 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
gcgaguangn

SEQ ID NO: 649 - RNA, 10 nt, Artificial Sequence
  Description of Artificial Sequence: Synthetic oligonucleotide
  modified_base (10)..(10): a, c, u, g, unknown or other
gcgaguaagn

SEQ ID NO: 650 - RNA, 10 nt, Artificial Sequence
  Description of Artificial Sequence: Synthetic oligonucleotide
  modified_base (10)..(10): a, c, u, g, unknown or other
gcgaguacgn

SEQ ID NO: 651 - RNA, 10 nt, Artificial Sequence
  Description of Artificial Sequence: Synthetic oligonucleotide
  modified_base (10)..(10): a, c, u, g, unknown or other
gcgaguaggn

SEQ ID NO: 652 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
ucgaguangn

SEQ ID NO: 653 - RNA, 10 nt, Artificial Sequence
  Description of Artificial Sequence: Synthetic oligonucleotide
  modified_base (10)..(10): a, c, u, g, unknown or other
ucgaguaagn

SEQ ID NO: 654 - RNA, 10 nt, Artificial Sequence
  Description of Artificial Sequence: Synthetic oligonucleotide
  modified_base (10)..(10): a, c, u, g, unknown or other
ucgaguacgn

SEQ ID NO: 655 - RNA, 10 nt, Artificial Sequence
  Description of Artificial Sequence: Synthetic oligonucleotide
  modified_base (10)..(10): a, c, u, g, unknown or other
ucgaguaggn

SEQ ID NO: 656 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
  modified_base (10)..(10): a, c, u, g, unknown or other
gngaguangn

SEQ ID NO: 657 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
gngaguaagn

SEQ ID NO: 658 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
gngaguacgn

SEQ ID NO: 659 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
gngaguaggn

SEQ ID NO: 660 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
  modified_base (10)..(10): a, c, u, g, unknown or other
nggaguangn

SEQ ID NO: 661 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
nggaguaagn

SEQ ID NO: 662 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
nggaguacgn

SEQ ID NO: 663 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
nggaguaggn

SEQ ID NO: 664 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
aggaguangn

SEQ ID NO: 665 - RNA, 10 nt, Artificial Sequence
  Description of Artificial Sequence: Synthetic oligonucleotide
  modified_base (10)..(10): a, c, u, g, unknown or other
aggaguaagn

SEQ ID NO: 666 - RNA, 10 nt, Artificial Sequence
  Description of Artificial Sequence: Synthetic oligonucleotide
  modified_base (10)..(10): a, c, u, g, unknown or other
aggaguacgn

SEQ ID NO: 667 - RNA, 10 nt, Artificial Sequence
  Description of Artificial Sequence: Synthetic oligonucleotide
  modified_base (10)..(10): a, c, u, g, unknown or other
aggaguaggn

SEQ ID NO: 668 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
cggaguangn

SEQ ID NO: 669 - RNA, 10 nt, Artificial Sequence
  Description of Artificial Sequence: Synthetic oligonucleotide
  modified_base (10)..(10): a, c, u, g, unknown or other
cggaguaagn

SEQ ID NO: 670 - RNA, 10 nt, Artificial Sequence
  Description of Artificial Sequence: Synthetic oligonucleotide
  modified_base (10)..(10): a, c, u, g, unknown or other
cggaguacgn

SEQ ID NO: 671 - RNA, 10 nt, Artificial Sequence
  Description of Artificial Sequence: Synthetic oligonucleotide
  modified_base (10)..(10): a, c, u, g, unknown or other
cggaguaggn

SEQ ID NO: 672 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
gggaguangn

SEQ ID NO: 673 - RNA, 10 nt, Artificial Sequence
  Description of Artificial Sequence: Synthetic oligonucleotide
  modified_base (10)..(10): a, c, u, g, unknown or other
gggaguaagn

SEQ ID NO: 674 - RNA, 10 nt, Artificial Sequence
  Description of Artificial Sequence: Synthetic oligonucleotide
  modified_base (10)..(10): a, c, u, g, unknown or other
gggaguacgn

SEQ ID NO: 675 - RNA, 10 nt, Artificial Sequence
  Description of Artificial Sequence: Synthetic oligonucleotide
  modified_base (10)..(10): a, c, u, g, unknown or other
gggaguaggn

SEQ ID NO: 676 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
uggaguangn

SEQ ID NO: 677 - RNA, 10 nt, Artificial Sequence
  Description of Artificial Sequence: Synthetic oligonucleotide
  modified_base (10)..(10): a, c, u, g, unknown or other
uggaguaagn

SEQ ID NO: 678 - RNA, 10 nt, Artificial Sequence
  Description of Artificial Sequence: Synthetic oligonucleotide
  modified_base (10)..(10): a, c, u, g, unknown or other
uggaguacgn

SEQ ID NO: 679 - RNA, 10 nt, Artificial Sequence
  Description of Artificial Sequence: Synthetic oligonucleotide
  modified_base (10)..(10): a, c, u, g, unknown or other
uggaguaggn

SEQ ID NO: 680 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
  modified_base (10)..(10): a, c, u, g, unknown or other
ungaguangn

SEQ ID NO: 681 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
ungaguaagn

SEQ ID NO: 682 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
ungaguacgn

SEQ ID NO: 683 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
ungaguaggn

SEQ ID NO: 684 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
  modified_base (10)..(10): a, c, u, g, unknown or other
nugaguangn

SEQ ID NO: 685 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
nugaguaagn

SEQ ID NO: 686 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
nugaguacgn

SEQ ID NO: 687 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
nugaguaggn

SEQ ID NO: 688 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
augaguangn

SEQ ID NO: 689 - RNA, 10 nt, Artificial Sequence
  Description of Artificial Sequence: Synthetic oligonucleotide
  modified_base (10)..(10): a, c, u, g, unknown or other
augaguaagn

SEQ ID NO: 690 - RNA, 10 nt, Artificial Sequence
  Description of Artificial Sequence: Synthetic oligonucleotide
  modified_base (10)..(10): a, c, u, g, unknown or other
augaguacgn

SEQ ID NO: 691 - RNA, 10 nt, Artificial Sequence
  Description of Artificial Sequence: Synthetic oligonucleotide
  modified_base (10)..(10): a, c, u, g, unknown or other
augaguaggn

SEQ ID NO: 692 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
cugaguangn

SEQ ID NO: 693 - RNA, 10 nt, Artificial Sequence
  Description of Artificial Sequence: Synthetic oligonucleotide
  modified_base (10)..(10): a, c, u, g, unknown or other
cugaguaagn

SEQ ID NO: 694 - RNA, 10 nt, Artificial Sequence
  Description of Artificial Sequence: Synthetic oligonucleotide
  modified_base (10)..(10): a, c, u, g, unknown or other
cugaguacgn

SEQ ID NO: 695 - RNA, 10 nt, Artificial Sequence
  Description of Artificial Sequence: Synthetic oligonucleotide
  modified_base (10)..(10): a, c, u, g, unknown or other
cugaguaggn

SEQ ID NO: 696 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
gugaguangn

SEQ ID NO: 697 - RNA, 10 nt, Artificial Sequence
  Description of Artificial Sequence: Synthetic oligonucleotide
  modified_base (10)..(10): a, c, u, g, unknown or other
gugaguaagn

SEQ ID NO: 698 - RNA, 10 nt, Artificial Sequence
  Description of Artificial Sequence: Synthetic oligonucleotide
  modified_base (10)..(10): a, c, u, g, unknown or other
gugaguacgn

SEQ ID NO: 699 - RNA, 10 nt, Artificial Sequence
  Description of Artificial Sequence: Synthetic oligonucleotide
  modified_base (10)..(10): a, c, u, g, unknown or other
gugaguaggn

SEQ ID NO: 700 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
uugaguangn

SEQ ID NO: 701 - RNA, 10 nt, Artificial Sequence
  Description of Artificial Sequence: Synthetic oligonucleotide
  modified_base (10)..(10): a, c, u, g, unknown or other
uugaguaagn

SEQ ID NO: 702 - RNA, 10 nt, Artificial Sequence
  Description of Artificial Sequence: Synthetic oligonucleotide
  modified_base (10)..(10): a, c, u, g, unknown or other
uugaguacgn

SEQ ID NO: 703 - RNA, 10 nt, Artificial Sequence
  Description of Artificial Sequence: Synthetic oligonucleotide
  modified_base (10)..(10): a, c, u, g, unknown or other
uugaguaggn

SEQ ID NO: 704 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
angaguaugn

SEQ ID NO: 705 - RNA, 10 nt, Artificial Sequence
  Description of Artificial Sequence: Synthetic oligonucleotide
  modified_base (2)..(2): a, c, u, g, unknown or other
angaguaaga

SEQ ID NO: 706 - RNA, 10 nt, Artificial Sequence
  Description of Artificial Sequence: Synthetic oligonucleotide
  modified_base (2)..(2): a, c, u, g, unknown or other
angaguacga

SEQ ID NO: 707 - RNA, 10 nt, Artificial Sequence
  Description of Artificial Sequence: Synthetic oligonucleotide
  modified_base (2)..(2): a, c, u, g, unknown or other
angaguagga

SEQ ID NO: 708 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
nagaguaugn

SEQ ID NO: 709 - RNA, 10 nt, Artificial Sequence
  Description of Artificial Sequence: Synthetic oligonucleotide
  modified_base (1)..(1): a, c, u, g, unknown or other
nagaguaaga

SEQ ID NO: 710 - RNA, 10 nt, Artificial Sequence
  Description of Artificial Sequence: Synthetic oligonucleotide
  modified_base (1)..(1): a, c, u, g, unknown or other
nagaguacga

SEQ ID NO: 711 - RNA, 10 nt, Artificial Sequence
  Description of Artificial Sequence: Synthetic oligonucleotide
  modified_base (1)..(1): a, c, u, g, unknown or other
nagaguagga

SEQ ID NO: 712 - RNA, 10 nt, Artificial Sequence
  Description of Artificial Sequence: Synthetic oligonucleotide
  modified_base (10)..(10): a, c, u, g, unknown or other
aagaguaugn

SEQ ID NO: 713 - RNA, 10 nt, Artificial Sequence
  Description of Artificial Sequence: Synthetic oligonucleotide
aagaguaaga

SEQ ID NO: 714 - RNA, 10 nt, Artificial Sequence
  Description of Artificial Sequence: Synthetic oligonucleotide
aagaguacga

SEQ ID NO: 715 - RNA, 10 nt, Artificial Sequence
  Description of Artificial Sequence: Synthetic oligonucleotide
aagaguagga

SEQ ID NO: 716 - RNA, 10 nt, Artificial Sequence
  Description of Artificial Sequence: Synthetic oligonucleotide
  modified_base (10)..(10): a, c, u, g, unknown or other
cagaguaugn

SEQ ID NO: 717 - RNA, 10 nt, Artificial Sequence
  Description of Artificial Sequence: Synthetic oligonucleotide
cagaguaaga

SEQ ID NO: 718 - RNA, 10 nt, Artificial Sequence
  Description of Artificial Sequence: Synthetic oligonucleotide
cagaguacga

SEQ ID NO: 719 - RNA, 10 nt, Artificial Sequence
  Description of Artificial Sequence: Synthetic oligonucleotide
cagaguagga

SEQ ID NO: 720 - RNA, 10 nt, Artificial Sequence
  Description of Artificial Sequence: Synthetic oligonucleotide
  modified_base (10)..(10): a, c, u, g, unknown or other
gagaguaugn

SEQ ID NO: 721 - RNA, 10 nt, Artificial Sequence
  Description of Artificial Sequence: Synthetic oligonucleotide
gagaguaaga

SEQ ID NO: 722 - RNA, 10 nt, Artificial Sequence
  Description of Artificial Sequence: Synthetic oligonucleotide
gagaguacga

SEQ ID NO: 723 - RNA, 10 nt, Artificial Sequence
  Description of Artificial Sequence: Synthetic oligonucleotide
gagaguagga

SEQ ID NO: 724 - RNA, 10 nt, Artificial Sequence
  Description of Artificial Sequence: Synthetic oligonucleotide
  modified_base (10)..(10): a, c, u, g, unknown or other
uagaguaugn

SEQ ID NO: 725 - RNA, 10 nt, Artificial Sequence
  Description of Artificial Sequence: Synthetic oligonucleotide
uagaguaaga

SEQ ID NO: 726 - RNA, 10 nt, Artificial Sequence
  Description of Artificial Sequence: Synthetic oligonucleotide
uagaguacga

SEQ ID NO: 727 - RNA, 10 nt, Artificial Sequence
  Description of Artificial Sequence: Synthetic oligonucleotide
uagaguagga

SEQ ID NO: 728 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
cngaguaugn

SEQ ID NO: 729 - RNA, 10 nt, Artificial Sequence
  Description of Artificial Sequence: Synthetic oligonucleotide
  modified_base (2)..(2): a, c, u, g, unknown or other
cngaguaaga

SEQ ID NO: 730 - RNA, 10 nt, Artificial Sequence
  Description of Artificial Sequence: Synthetic oligonucleotide
  modified_base (2)..(2): a, c, u, g, unknown or other
cngaguacga

SEQ ID NO: 731 - RNA, 10 nt, Artificial Sequence
  Description of Artificial Sequence: Synthetic oligonucleotide
  modified_base (2)..(2): a, c, u, g, unknown or other
cngaguagga

SEQ ID NO: 732 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
ncgaguaugn

SEQ ID NO: 733 - RNA, 10 nt, Artificial Sequence
  Description of Artificial Sequence: Synthetic oligonucleotide
  modified_base (1)..(1): a, c, u, g, unknown or other
ncgaguaaga

SEQ ID NO: 734 - RNA, 10 nt, Artificial Sequence
  Description of Artificial Sequence: Synthetic oligonucleotide
  modified_base (1)..(1): a, c, u, g, unknown or other
ncgaguacga

SEQ ID NO: 735 - RNA, 10 nt, Artificial Sequence
  Description of Artificial Sequence: Synthetic oligonucleotide
  modified_base (1)..(1): a, c, u, g, unknown or other
ncgaguagga

SEQ ID NO: 736 - RNA, 10 nt, Artificial Sequence
  Description of Artificial Sequence: Synthetic oligonucleotide
  modified_base (10)..(10): a, c, u, g, unknown or other
acgaguaugn

SEQ ID NO: 737 - RNA, 10 nt, Artificial Sequence
  Description of Artificial Sequence: Synthetic oligonucleotide
acgaguaaga

SEQ ID NO: 738 - RNA, 10 nt, Artificial Sequence
  Description of Artificial Sequence: Synthetic oligonucleotide
acgaguacga

SEQ ID NO: 739 - RNA, 10 nt, Artificial Sequence
  Description of Artificial Sequence: Synthetic oligonucleotide
acgaguagga

SEQ ID NO: 740 - RNA, 10 nt, Artificial Sequence
  Description of Artificial Sequence: Synthetic oligonucleotide
  modified_base (10)..(10): a, c, u, g, unknown or other
ccgaguaugn

SEQ ID NO: 741 - RNA, 10 nt, Artificial Sequence
  Description of Artificial Sequence: Synthetic oligonucleotide
ccgaguaaga

SEQ ID NO: 742 - RNA, 10 nt, Artificial Sequence
  Description of Artificial Sequence: Synthetic oligonucleotide
ccgaguacga

SEQ ID NO: 743 - RNA, 10 nt, Artificial Sequence
  Description of Artificial Sequence: Synthetic oligonucleotide
ccgaguagga

SEQ ID NO: 744 - RNA, 10 nt, Artificial Sequence
  Description of Artificial Sequence: Synthetic oligonucleotide
  modified_base (10)..(10): a, c, u, g, unknown or other
gcgaguaugn

SEQ ID NO: 745 - RNA, 10 nt, Artificial Sequence
  Description of Artificial Sequence: Synthetic oligonucleotide
gcgaguaaga

SEQ ID NO: 746 - RNA, 10 nt, Artificial Sequence
  Description of Artificial Sequence: Synthetic oligonucleotide
gcgaguacga

SEQ ID NO: 747 - RNA, 10 nt, Artificial Sequence
  Description of Artificial Sequence: Synthetic oligonucleotide
gcgaguagga

SEQ ID NO: 748 - RNA, 10 nt, Artificial Sequence
  Description of Artificial Sequence: Synthetic oligonucleotide
  modified_base (10)..(10): a, c, u, g, unknown or other
ucgaguaugn

SEQ ID NO: 749 - RNA, 10 nt, Artificial Sequence
  Description of Artificial Sequence: Synthetic oligonucleotide
ucgaguaaga

SEQ ID NO: 750 - RNA, 10 nt, Artificial Sequence
  Description of Artificial Sequence: Synthetic oligonucleotide
ucgaguacga

SEQ ID NO: 751 - RNA, 10 nt, Artificial Sequence
  Description of Artificial Sequence: Synthetic oligonucleotide
ucgaguagga

SEQ ID NO: 752 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
gngaguaugn

SEQ ID NO: 753 - RNA, 10 nt, Artificial Sequence
  Description of Artificial Sequence: Synthetic oligonucleotide
  modified_base (2)..(2): a, c, u, g, unknown or other
gngaguaaga

SEQ ID NO: 754 - RNA, 10 nt, Artificial Sequence
  Description of Artificial Sequence: Synthetic oligonucleotide
  modified_base (2)..(2): a, c, u, g, unknown or other
gngaguacga

SEQ ID NO: 755 - RNA, 10 nt, Artificial Sequence
  Description of Artificial Sequence: Synthetic oligonucleotide
  modified_base (2)..(2): a, c, u, g, unknown or other
gngaguagga

SEQ ID NO: 756 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
nggaguaugn

SEQ ID NO: 757 - RNA, 10 nt, Artificial Sequence
  Description of Artificial Sequence: Synthetic oligonucleotide
  modified_base (1)..(1): a, c, u, g, unknown or other
nggaguaaga

SEQ ID NO: 758 - RNA, 10 nt, Artificial Sequence
  Description of Artificial Sequence: Synthetic oligonucleotide
  modified_base (1)..(1): a, c, u, g, unknown or other
nggaguacga

SEQ ID NO: 759 - RNA, 10 nt, Artificial Sequence
  Description of Artificial Sequence: Synthetic oligonucleotide
  modified_base (1)..(1): a, c, u, g, unknown or other
nggaguagga

SEQ ID NO: 760 - RNA, 10 nt, Artificial Sequence
  Description of Artificial Sequence: Synthetic oligonucleotide
  modified_base (10)..(10): a, c, u, g, unknown or other
aggaguaugn

SEQ ID NO: 761 - RNA, 10 nt, Artificial Sequence
  Description of Artificial Sequence: Synthetic oligonucleotide
aggaguaaga

SEQ ID NO: 762 - RNA, 10 nt, Artificial Sequence
  Description of Artificial Sequence: Synthetic oligonucleotide
aggaguacga

SEQ ID NO: 763 - RNA, 10 nt, Artificial Sequence
  Description of Artificial Sequence: Synthetic oligonucleotide
aggaguagga

SEQ ID NO: 764 - RNA, 10 nt, Artificial Sequence
  Description of Artificial Sequence: Synthetic oligonucleotide
  modified_base (10)..(10): a, c, u, g, unknown or other
cggaguaugn

SEQ ID NO: 765 - RNA, 10 nt, Artificial Sequence
  Description of Artificial Sequence: Synthetic oligonucleotide
cggaguaaga

SEQ ID NO: 766 - RNA, 10 nt, Artificial Sequence
  Description of Artificial Sequence: Synthetic oligonucleotide
cggaguacga

SEQ ID NO: 767 - RNA, 10 nt, Artificial Sequence
  Description of Artificial Sequence: Synthetic oligonucleotide
cggaguagga

SEQ ID NO: 768 - RNA, 10 nt, Artificial Sequence
  Description of Artificial Sequence: Synthetic oligonucleotide
  modified_base (10)..(10): a, c, u, g, unknown or other
gggaguaugn

SEQ ID NO: 769 - RNA, 10 nt, Artificial Sequence
  Description of Artificial Sequence: Synthetic oligonucleotide
gggaguaaga

SEQ ID NO: 770 - RNA, 10 nt, Artificial Sequence
  Description of Artificial Sequence: Synthetic oligonucleotide
gggaguacga

SEQ ID NO: 771 - RNA, 10 nt, Artificial Sequence
  Description of Artificial Sequence: Synthetic oligonucleotide
gggaguagga

SEQ ID NO: 772 - RNA, 10 nt, Artificial Sequence
  Description of Artificial Sequence: Synthetic oligonucleotide
  modified_base (10)..(10): a, c, u, g, unknown or other
uggaguaugn

SEQ ID NO: 773 - RNA, 10 nt, Artificial Sequence
  Description of Artificial Sequence: Synthetic oligonucleotide
uggaguaaga

SEQ ID NO: 774 - RNA, 10 nt, Artificial Sequence
  Description of Artificial Sequence: Synthetic oligonucleotide
uggaguacga

SEQ ID NO: 775 - RNA, 10 nt, Artificial Sequence
  Description of Artificial Sequence: Synthetic oligonucleotide
uggaguagga

SEQ ID NO: 776 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
ungaguaugn

SEQ ID NO: 777 - RNA, 10 nt, Artificial Sequence
  Description of Artificial Sequence: Synthetic oligonucleotide
  modified_base (2)..(2): a, c, u, g, unknown or other
ungaguaaga

SEQ ID NO: 778 - RNA, 10 nt, Artificial Sequence
  Description of Artificial Sequence: Synthetic oligonucleotide
  modified_base (2)..(2): a, c, u, g, unknown or other
ungaguacga

SEQ ID NO: 779 - RNA, 10 nt, Artificial Sequence
  Description of Artificial Sequence: Synthetic oligonucleotide
  modified_base (2)..(2): a, c, u, g, unknown or other
ungaguagga

SEQ ID NO: 780 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
nugaguaugn

SEQ ID NO: 781 - RNA, 10 nt, Artificial Sequence
  Description of Artificial Sequence: Synthetic oligonucleotide
  modified_base (1)..(1): a, c, u, g, unknown or other
nugaguaaga

SEQ ID NO: 782 - RNA, 10 nt, Artificial Sequence
  Description of Artificial Sequence: Synthetic oligonucleotide
  modified_base (1)..(1): a, c, u, g, unknown or other
nugaguacga

SEQ ID NO: 783 - RNA, 10 nt, Artificial Sequence
  Description of Artificial Sequence: Synthetic oligonucleotide
  modified_base (1)..(1): a, c, u, g, unknown or other
nugaguagga

SEQ ID NO: 784 - RNA, 10 nt, Artificial Sequence
  Description of Artificial Sequence: Synthetic oligonucleotide
  modified_base (10)..(10): a, c, u, g, unknown or other
augaguaugn

SEQ ID NO: 785 - RNA, 10 nt, Artificial Sequence
  Description of Artificial Sequence: Synthetic oligonucleotide
augaguaaga

SEQ ID NO: 786 - RNA, 10 nt, Artificial Sequence
  Description of Artificial Sequence: Synthetic oligonucleotide
augaguacga

SEQ ID NO: 787 - RNA, 10 nt, Artificial Sequence
  Description of Artificial Sequence: Synthetic oligonucleotide
augaguagga

SEQ ID NO: 788 - RNA, 10 nt, Artificial Sequence
  Description of Artificial Sequence: Synthetic oligonucleotide
  modified_base (10)..(10): a, c, u, g, unknown or other
cugaguaugn

SEQ ID NO: 789 - RNA, 10 nt, Artificial Sequence
  Description of Artificial Sequence: Synthetic oligonucleotide
cugaguaaga

SEQ ID NO: 790 - RNA, 10 nt, Artificial Sequence
  Description of Artificial Sequence: Synthetic oligonucleotide
cugaguacga

SEQ ID NO: 791 - RNA, 10 nt, Artificial Sequence
  Description of Artificial Sequence: Synthetic oligonucleotide
cugaguagga

SEQ ID NO: 792 - RNA, 10 nt, Artificial Sequence
  Description of Artificial Sequence: Synthetic oligonucleotide
  modified_base (10)..(10): a, c, u, g, unknown or other
gugaguaugn

SEQ ID NO: 793 - RNA, 10 nt, Artificial Sequence
  Description of Artificial Sequence: Synthetic oligonucleotide
gugaguaaga

SEQ ID NO: 794 - RNA, 10 nt, Artificial Sequence
  Description of Artificial Sequence: Synthetic oligonucleotide
gugaguacga

SEQ ID NO: 795 - RNA, 10 nt, Artificial Sequence
  Description of Artificial Sequence: Synthetic oligonucleotide
gugaguagga

SEQ ID NO: 796 - RNA, 10 nt, Artificial Sequence
  Description of Artificial Sequence: Synthetic oligonucleotide
  modified_base (10)..(10): a, c, u, g, unknown or other
uugaguaugn

SEQ ID NO: 797 - RNA, 10 nt, Artificial Sequence
  Description of Artificial Sequence: Synthetic oligonucleotide
uugaguaaga

SEQ ID NO: 798 - RNA, 10 nt, Artificial Sequence
  Description of Artificial Sequence: Synthetic oligonucleotide
uugaguacga

SEQ ID NO: 799 - RNA, 10 nt, Artificial Sequence
  Description of Artificial Sequence: Synthetic oligonucleotide
uugaguagga

SEQ ID NO: 800 - RNA, 10 nt, Artificial Sequence
  Description of Artificial Sequence: Synthetic oligonucleotide
  modified_base (2)..(2): a, c, u, g, unknown or other
angaguauga

SEQ ID NO: 801 - RNA, 10 nt, Artificial Sequence
  Description of Artificial Sequence: Synthetic oligonucleotide
  modified_base (2)..(2): a, c, u, g, unknown or other
angaguaagc

SEQ ID NO: 802 - RNA, 10 nt, Artificial Sequence
  Description of Artificial Sequence: Synthetic oligonucleotide
  modified_base (2)..(2): a, c, u, g, unknown or other
angaguacgc

SEQ ID NO: 803 - RNA, 10 nt, Artificial Sequence
  Description of Artificial Sequence: Synthetic oligonucleotide
  modified_base (2)..(2): a, c, u, g, unknown or other
angaguaggc

SEQ ID NO: 804 - RNA, 10 nt, Artificial Sequence
  Description of Artificial Sequence: Synthetic oligonucleotide
  modified_base (1)..(1): a, c, u, g, unknown or other
nagaguauga

SEQ ID NO: 805 - RNA, 10 nt, Artificial Sequence
  Description of Artificial Sequence: Synthetic oligonucleotide
  modified_base (1)..(1): a, c, u, g, unknown or other
nagaguaagc

SEQ ID NO: 806 - RNA, 10 nt, Artificial Sequence
  Description of Artificial Sequence: Synthetic oligonucleotide
  modified_base (1)..(1): a, c, u, g, unknown or other
nagaguacgc

SEQ ID NO: 807 - RNA, 10 nt, Artificial Sequence
  Description of Artificial Sequence: Synthetic oligonucleotide
  modified_base (1)..(1): a, c, u, g, unknown or other
nagaguaggc

SEQ ID NO: 808 - RNA, 10 nt, Artificial Sequence
  Description of Artificial Sequence: Synthetic oligonucleotide
aagaguauga

SEQ ID NO: 809 - RNA, 10 nt, Artificial Sequence
  Description of Artificial Sequence: Synthetic oligonucleotide
aagaguaagc

SEQ ID NO: 810 - RNA, 10 nt, Artificial Sequence
  Description of Artificial Sequence: Synthetic oligonucleotide
aagaguacgc

SEQ ID NO: 811 - RNA, 10 nt, Artificial Sequence
  Description of Artificial Sequence: Synthetic oligonucleotide
aagaguaggc

SEQ ID NO: 812 - RNA, 10 nt, Artificial Sequence
  Description of Artificial Sequence: Synthetic oligonucleotide
cagaguauga

SEQ ID NO: 813 - RNA, 10 nt, Artificial Sequence
  Description of Artificial Sequence: Synthetic oligonucleotide
cagaguaagc

SEQ ID NO: 814 - RNA, 10 nt, Artificial Sequence
  Description of Artificial Sequence: Synthetic oligonucleotide
cagaguacgc

SEQ ID NO: 815 - RNA, 10 nt, Artificial Sequence
  Description of Artificial Sequence: Synthetic oligonucleotide
cagaguaggc

SEQ ID NO: 816 - RNA, 10 nt, Artificial Sequence
  Description of Artificial Sequence: Synthetic oligonucleotide
gagaguauga

SEQ ID NO: 817 - RNA, 10 nt, Artificial Sequence
  Description of Artificial Sequence: Synthetic oligonucleotide
gagaguaagc

SEQ ID NO: 818 - RNA, 10 nt, Artificial Sequence
  Description of Artificial Sequence: Synthetic oligonucleotide
gagaguacgc

SEQ ID NO: 819 - RNA, 10 nt, Artificial Sequence
  Description of Artificial Sequence: Synthetic oligonucleotide
gagaguaggc

SEQ ID NO: 820 - RNA, 10 nt, Artificial Sequence
  Description of Artificial Sequence: Synthetic oligonucleotide
uagaguauga

SEQ ID NO: 821 - RNA, 10 nt, Artificial Sequence
  Description of Artificial Sequence: Synthetic oligonucleotide
uagaguaagc

SEQ ID NO: 822 - RNA, 10 nt, Artificial Sequence
  Description of Artificial Sequence: Synthetic oligonucleotide
uagaguacgc

SEQ ID NO: 823 - RNA, 10 nt, Artificial Sequence
  Description of Artificial Sequence: Synthetic oligonucleotide
uagaguaggc

SEQ ID NO: 824 - RNA, 10 nt, Artificial Sequence
  Description of Artificial Sequence: Synthetic oligonucleotide
  modified_base (2)..(2): a, c, u, g, unknown or other
cngaguauga

SEQ ID NO: 825 - RNA, 10 nt, Artificial Sequence
  Description of Artificial Sequence: Synthetic oligonucleotide
  modified_base (2)..(2): a, c, u, g, unknown or other
cngaguaagc

SEQ ID NO: 826 - RNA, 10 nt, Artificial Sequence
  Description of Artificial Sequence: Synthetic oligonucleotide
  modified_base (2)..(2): a, c, u, g, unknown or other
cngaguacgc

SEQ ID NO: 827 - RNA, 10 nt, Artificial Sequence
  Description of Artificial Sequence: Synthetic oligonucleotide
  modified_base (2)..(2): a, c, u, g, unknown or other
cngaguaggc

SEQ ID NO: 828 - RNA, 10 nt, Artificial Sequence
  Description of Artificial Sequence: Synthetic oligonucleotide
  modified_base (1)..(1): a, c, u, g, unknown or other
ncgaguauga

SEQ ID NO: 829 - RNA, 10 nt, Artificial Sequence
  Description of Artificial Sequence: Synthetic oligonucleotide
  modified_base (1)..(1): a, c, u, g, unknown or other
ncgaguaagc

SEQ ID NO: 830 - RNA, 10 nt, Artificial Sequence
  Description of Artificial Sequence: Synthetic oligonucleotide
  modified_base (1)..(1): a, c, u, g, unknown or other
ncgaguacgc

SEQ ID NO: 831 - RNA, 10 nt, Artificial Sequence
  Description of Artificial Sequence: Synthetic oligonucleotide
  modified_base (1)..(1): a, c, u, g, unknown or other
ncgaguaggc

SEQ ID NO: 832 - RNA, 10 nt, Artificial Sequence
  Description of Artificial Sequence: Synthetic oligonucleotide
acgaguauga

SEQ ID NO: 833 - RNA, 10 nt, Artificial Sequence
  Description of Artificial Sequence: Synthetic oligonucleotide
acgaguaagc

SEQ ID NO: 834 - RNA, 10 nt, Artificial Sequence
  Description of Artificial Sequence: Synthetic oligonucleotide
acgaguacgc

SEQ ID NO: 835 - RNA, 10 nt, Artificial Sequence
  Description of Artificial Sequence: Synthetic oligonucleotide
acgaguaggc

SEQ ID NO: 836 - RNA, 10 nt, Artificial Sequence
  Description of Artificial Sequence: Synthetic oligonucleotide
ccgaguauga

SEQ ID NO: 837 - RNA, 10 nt, Artificial Sequence
  Description of Artificial Sequence: Synthetic oligonucleotide
ccgaguaagc

SEQ ID NO: 838 - RNA, 10 nt, Artificial Sequence
  Description of Artificial Sequence: Synthetic oligonucleotide
ccgaguacgc

SEQ ID NO: 839 - RNA, 10 nt, Artificial Sequence
  Description of Artificial Sequence: Synthetic oligonucleotide
ccgaguaggc

SEQ ID NO: 840 - RNA, 10 nt, Artificial Sequence
  Description of Artificial Sequence: Synthetic oligonucleotide
gcgaguauga

SEQ ID NO: 841 - RNA, 10 nt, Artificial Sequence
  Description of Artificial Sequence: Synthetic oligonucleotide
gcgaguaagc

SEQ ID NO: 842 - RNA, 10 nt, Artificial Sequence
  Description of Artificial Sequence: Synthetic oligonucleotide
gcgaguacgc

SEQ ID NO: 843 - RNA, 10 nt, Artificial Sequence
  Description of Artificial Sequence: Synthetic oligonucleotide
gcgaguaggc

SEQ ID NO: 844 - RNA, 10 nt, Artificial Sequence
  Description of Artificial Sequence: Synthetic oligonucleotide
ucgaguauga

SEQ ID NO: 845 - RNA, 10 nt, Artificial Sequence
  Description of Artificial Sequence: Synthetic oligonucleotide
ucgaguaagc

SEQ ID NO: 846 - RNA, 10 nt, Artificial Sequence
  Description of Artificial Sequence: Synthetic oligonucleotide
ucgaguacgc

SEQ ID NO: 847 - RNA, 10 nt, Artificial Sequence
  Description of Artificial Sequence: Synthetic oligonucleotide
ucgaguaggc

SEQ ID NO: 848 - RNA, 10 nt, Artificial Sequence
  Description of Artificial Sequence: Synthetic oligonucleotide
  modified_base (2)..(2): a, c, u, g, unknown or other
gngaguauga

SEQ ID NO: 849 - RNA, 10 nt, Artificial Sequence
  Description of Artificial Sequence: Synthetic oligonucleotide
  modified_base (2)..(2): a, c, u, g, unknown or other
gngaguaagc

SEQ ID NO: 850 - RNA, 10 nt, Artificial Sequence
  Description of Artificial Sequence: Synthetic oligonucleotide
  modified_base (2)..(2): a, c, u, g, unknown or other
gngaguacgc

SEQ ID NO: 851 - RNA, 10 nt, Artificial Sequence
  Description of Artificial Sequence: Synthetic oligonucleotide
  modified_base (2)..(2): a, c, u, g, unknown or other
gngaguaggc

SEQ ID NO: 852 - RNA, 10 nt, Artificial Sequence
  Description of Artificial Sequence: Synthetic oligonucleotide
  modified_base (1)..(1): a, c, u, g, unknown or other
nggaguauga

SEQ ID NO: 853 - RNA, 10 nt, Artificial Sequence
  Description of Artificial Sequence: Synthetic oligonucleotide
  modified_base (1)..(1): a, c, u, g, unknown or other
nggaguaagc

SEQ ID NO: 854 - RNA, 10 nt, Artificial Sequence
  Description of Artificial Sequence: Synthetic oligonucleotide
  modified_base (1)..(1): a, c, u, g, unknown or other
nggaguacgc

SEQ ID NO: 855 - RNA, 10 nt, Artificial Sequence
  Description of Artificial Sequence: Synthetic oligonucleotide
  modified_base (1)..(1): a, c, u, g, unknown or other
nggaguaggc

SEQ ID NO: 856 - RNA, 10 nt, Artificial Sequence
  Description of Artificial Sequence: Synthetic oligonucleotide
aggaguauga

SEQ ID NO: 857 - RNA, 10 nt, Artificial Sequence
  Description of Artificial Sequence: Synthetic oligonucleotide
aggaguaagc

SEQ ID NO: 858 - RNA, 10 nt, Artificial Sequence
  Description of Artificial Sequence: Synthetic oligonucleotide
aggaguacgc

SEQ ID NO: 859 - RNA, 10 nt, Artificial Sequence
  Description of Artificial Sequence: Synthetic oligonucleotide
aggaguaggc

SEQ ID NO: 860 - RNA, 10 nt, Artificial Sequence
  Description of Artificial Sequence: Synthetic oligonucleotide
cggaguauga

SEQ ID NO: 861 - RNA, 10 nt, Artificial Sequence
  Description of Artificial Sequence: Synthetic oligonucleotide
cggaguaagc

SEQ ID NO: 862 - RNA, 10 nt, Artificial Sequence
  Description of Artificial Sequence: Synthetic oligonucleotide
cggaguacgc

SEQ ID NO: 863 - RNA, 10 nt, Artificial Sequence
  Description of Artificial Sequence: Synthetic oligonucleotide
cggaguaggc

SEQ ID NO: 864 - RNA, 10 nt, Artificial Sequence
  Description of Artificial Sequence: Synthetic oligonucleotide
gggaguauga

SEQ ID NO: 865 - RNA, 10 nt, Artificial Sequence
  Description of Artificial Sequence: Synthetic oligonucleotide
gggaguaagc

SEQ ID NO: 866 - RNA, 10 nt, Artificial Sequence
  Description of Artificial Sequence: Synthetic oligonucleotide
gggaguacgc

SEQ ID NO: 867 - RNA, 10 nt, Artificial Sequence
  Description of Artificial Sequence: Synthetic oligonucleotide
gggaguaggc

SEQ ID NO: 868 - RNA, 10 nt, Artificial Sequence
  Description of Artificial Sequence: Synthetic oligonucleotide
uggaguauga

SEQ ID NO: 869 - RNA, 10 nt, Artificial Sequence
  Description of Artificial Sequence: Synthetic oligonucleotide
uggaguaagc

SEQ ID NO: 870 - RNA, 10 nt, Artificial Sequence
  Description of Artificial Sequence: Synthetic oligonucleotide
uggaguacgc

SEQ ID NO: 871 - RNA, 10 nt, Artificial Sequence
  Description of Artificial Sequence: Synthetic oligonucleotide
uggaguaggc

SEQ ID NO: 872 - RNA, 10 nt, Artificial Sequence
  Description of Artificial Sequence: Synthetic oligonucleotide
  modified_base (2)..(2): a, c, u, g, unknown or other
ungaguauga

SEQ ID NO: 873 - RNA, 10 nt, Artificial Sequence
  Description of Artificial Sequence: Synthetic oligonucleotide
  modified_base (2)..(2): a, c, u, g, unknown or other
ungaguaagc

SEQ ID NO: 874 - RNA, 10 nt, Artificial Sequence
  Description of Artificial Sequence: Synthetic oligonucleotide
  modified_base (2)..(2): a, c, u, g, unknown or other
ungaguacgc

SEQ ID NO: 875 - RNA, 10 nt, Artificial Sequence
  Description of Artificial Sequence: Synthetic oligonucleotide
  modified_base (2)..(2): a, c, u, g, unknown or other
ungaguaggc

SEQ ID NO: 876 - RNA, 10 nt, Artificial Sequence
  Description of Artificial Sequence: Synthetic oligonucleotide
  modified_base (1)..(1): a, c, u, g, unknown or other
nugaguauga

SEQ ID NO: 877 - RNA, 10 nt, Artificial Sequence
  Description of Artificial Sequence: Synthetic oligonucleotide
  modified_base (1)..(1): a, c, u, g, unknown or other
nugaguaagc

SEQ ID NO: 878 - RNA, 10 nt, Artificial Sequence
  Description of Artificial Sequence: Synthetic oligonucleotide
  modified_base (1)..(1): a, c, u, g, unknown or other
nugaguacgc

SEQ ID NO: 879 - RNA, 10 nt, Artificial Sequence
  Description of Artificial Sequence: Synthetic oligonucleotide
  modified_base (1)..(1): a, c, u, g, unknown or other
nugaguaggc

SEQ ID NO: 880 - RNA, 10 nt, Artificial Sequence
  Description of Artificial Sequence: Synthetic oligonucleotide
augaguauga

SEQ ID NO: 881 - RNA, 10 nt, Artificial Sequence
  Description of Artificial Sequence: Synthetic oligonucleotide
augaguaagc

SEQ ID NO: 882 - RNA, 10 nt, Artificial Sequence
  Description of Artificial Sequence: Synthetic oligonucleotide
augaguacgc

SEQ ID NO: 883 - RNA, 10 nt, Artificial Sequence
  Description of Artificial Sequence: Synthetic oligonucleotide
augaguaggc

SEQ ID NO: 884 - RNA, 10 nt, Artificial Sequence
  Description of Artificial Sequence: Synthetic oligonucleotide
cugaguauga

SEQ ID NO: 885 - RNA, 10 nt, Artificial Sequence
  Description of Artificial Sequence: Synthetic oligonucleotide
cugaguaagc

SEQ ID NO: 886 - RNA, 10 nt, Artificial Sequence
  Description of Artificial Sequence: Synthetic oligonucleotide
cugaguacgc

SEQ ID NO: 887 - RNA, 10 nt, Artificial Sequence
  Description of Artificial Sequence: Synthetic oligonucleotide
cugaguaggc

SEQ ID NO: 888 - RNA, 10 nt, Artificial Sequence
  Description of Artificial Sequence: Synthetic oligonucleotide
gugaguauga

SEQ ID NO: 889 - RNA, 10 nt, Artificial Sequence
  Description of Artificial Sequence: Synthetic oligonucleotide
gugaguaagc

SEQ ID NO: 890 - RNA, 10 nt, Artificial Sequence
  Description of Artificial Sequence: Synthetic oligonucleotide
gugaguacgc

SEQ ID NO: 891 - RNA, 10 nt, Artificial Sequence
  Description of Artificial Sequence: Synthetic oligonucleotide
gugaguaggc

SEQ ID NO: 892 - RNA, 10 nt, Artificial Sequence
  Description of Artificial Sequence: Synthetic oligonucleotide
uugaguauga

SEQ ID NO: 893 - RNA, 10 nt, Artificial Sequence
  Description of Artificial Sequence: Synthetic oligonucleotide
uugaguaagc

SEQ ID NO: 894 - RNA, 10 nt, Artificial Sequence
  Description of Artificial Sequence: Synthetic oligonucleotide
uugaguacgc

SEQ ID NO: 895 - RNA, 10 nt, Artificial Sequence
  Description of Artificial Sequence: Synthetic oligonucleotide
uugaguaggc

SEQ ID NO: 896 - RNA, 10 nt, Artificial Sequence
  Description of Artificial Sequence: Synthetic oligonucleotide
  modified_base (2)..(2): a, c, u, g, unknown or other
angaguaugc

SEQ ID NO: 897 - RNA, 10 nt, Artificial Sequence
  Description of Artificial Sequence: Synthetic oligonucleotide
  modified_base (2)..(2): a, c, u, g, unknown or other
angaguaagg

SEQ ID NO: 898 - RNA, 10 nt, Artificial Sequence
  Description of Artificial Sequence: Synthetic oligonucleotide
  modified_base (2)..(2): a, c, u, g, unknown or other
angaguacgg

SEQ ID NO: 899 - RNA, 10 nt, Artificial Sequence
  Description of Artificial Sequence: Synthetic oligonucleotide
  modified_base (2)..(2): a, c, u, g, unknown or other
angaguaggg

SEQ ID NO: 900 - RNA, 10 nt, Artificial Sequence
  Description of Artificial Sequence: Synthetic oligonucleotide
  modified_base (1)..(1): a, c, u, g, unknown or other
nagaguaugc

SEQ ID NO: 901 - RNA, 10 nt, Artificial Sequence
  Description of Artificial Sequence: Synthetic oligonucleotide
  modified_base (1)..(1): a, c, u, g, unknown or other
nagaguaagg

SEQ ID NO: 902 - RNA, 10 nt, Artificial Sequence
  Description of Artificial Sequence: Synthetic oligonucleotide
  modified_base (1)..(1): a, c, u, g, unknown or other
nagaguacgg

SEQ ID NO: 903 - RNA, 10 nt, Artificial Sequence
  Description of Artificial Sequence: Synthetic oligonucleotide
  modified_base (1)..(1): a, c, u, g, unknown or other
nagaguaggg

SEQ ID NO: 904 - RNA, 10 nt, Artificial Sequence
  Description of Artificial Sequence: Synthetic oligonucleotide
aagaguaugc

SEQ ID NO: 905 - RNA, 10 nt, Artificial Sequence
  Description of Artificial Sequence: Synthetic oligonucleotide
aagaguaagg

SEQ ID NO: 906 - RNA, 10 nt, Artificial Sequence
  Description of Artificial Sequence: Synthetic oligonucleotide
aagaguacgg

SEQ ID NO: 907 - RNA, 10 nt, Artificial Sequence
  Description of Artificial Sequence: Synthetic oligonucleotide
aagaguaggg

SEQ ID NO: 908 - RNA, 10 nt, Artificial Sequence
  Description of Artificial Sequence: Synthetic oligonucleotide
cagaguaugc

SEQ ID NO: 909 - RNA, 10 nt, Artificial Sequence
  Description of Artificial Sequence: Synthetic oligonucleotide
cagaguaagg

SEQ ID NO: 910 - RNA, 10 nt, Artificial Sequence
  Description of Artificial Sequence: Synthetic oligonucleotide
cagaguacgg

SEQ ID NO: 911 - RNA, 10 nt, Artificial Sequence
  Description of Artificial Sequence: Synthetic oligonucleotide
cagaguaggg

SEQ ID NO: 912 - RNA, 10 nt, Artificial Sequence
  Description of Artificial Sequence: Synthetic oligonucleotide
gagaguaugc

SEQ ID NO: 913 - RNA, 10 nt, Artificial Sequence
  Description of Artificial Sequence: Synthetic oligonucleotide
gagaguaagg

SEQ ID NO: 914 - RNA, 10 nt, Artificial Sequence
  Description of Artificial Sequence: Synthetic oligonucleotide
gagaguacgg

SEQ ID NO: 915 - RNA, 10 nt, Artificial Sequence
  Description of Artificial Sequence: Synthetic oligonucleotide
gagaguaggg

SEQ ID NO: 916 - RNA, 10 nt, Artificial Sequence
  Description of Artificial Sequence: Synthetic oligonucleotide
uagaguaugc

SEQ ID NO: 917 - RNA, 10 nt, Artificial Sequence
  Description of Artificial Sequence: Synthetic oligonucleotide
uagaguaagg

SEQ ID NO: 918 - RNA, 10 nt, Artificial Sequence
  Description of Artificial Sequence: Synthetic oligonucleotide
uagaguacgg

SEQ ID NO: 919 - RNA, 10 nt, Artificial Sequence
  Description of Artificial Sequence: Synthetic oligonucleotide
uagaguaggg

SEQ ID NO: 920 - RNA, 10 nt, Artificial Sequence
  Description of Artificial Sequence: Synthetic oligonucleotide
  modified_base (2)..(2): a, c, u, g, unknown or other
cngaguaugc

SEQ ID NO: 921 - RNA, 10 nt, Artificial Sequence
  Description of Artificial Sequence: Synthetic oligonucleotide
  modified_base (2)..(2): a, c, u, g, unknown or other
cngaguaagg

SEQ ID NO: 922 - RNA, 10 nt, Artificial Sequence
  Description of Artificial Sequence: Synthetic oligonucleotide
  modified_base (2)..(2): a, c, u, g, unknown or other
cngaguacgg

SEQ ID NO: 923 - RNA, 10 nt, Artificial Sequence
  Description of Artificial Sequence: Synthetic oligonucleotide
  modified_base (2)..(2): a, c, u, g, unknown or other
cngaguaggg

SEQ ID NO: 924 - RNA, 10 nt, Artificial Sequence
  Description of Artificial Sequence: Synthetic oligonucleotide
  modified_base (1)..(1): a, c, u, g, unknown or other
ncgaguaugc

SEQ ID NO: 925 - RNA, 10 nt, Artificial Sequence
  Description of Artificial Sequence: Synthetic oligonucleotide
  modified_base (1)..(1): a, c, u, g, unknown or other
ncgaguaagg

SEQ ID NO: 926 - RNA, 10 nt, Artificial Sequence
  Description of Artificial Sequence: Synthetic oligonucleotide
  modified_base (1)..(1): a, c, u, g, unknown or other
ncgaguacgg

SEQ ID NO: 927 - RNA, 10 nt, Artificial Sequence
  Description of Artificial Sequence: Synthetic oligonucleotide
  modified_base (1)..(1): a, c, u, g, unknown or other
ncgaguaggg

SEQ ID NO: 928 - RNA, 10 nt, Artificial Sequence
  Description of Artificial Sequence: Synthetic oligonucleotide
acgaguaugc

SEQ ID NO: 929 - RNA, 10 nt, Artificial Sequence
  Description of Artificial Sequence: Synthetic oligonucleotide
acgaguaagg

SEQ ID NO: 930 - RNA, 10 nt, Artificial Sequence
  Description of Artificial Sequence: Synthetic oligonucleotide
acgaguacgg

SEQ ID NO: 931 - RNA, 10 nt, Artificial Sequence
  Description of Artificial Sequence: Synthetic oligonucleotide
acgaguaggg

SEQ ID NO: 932 - RNA, 10 nt, Artificial Sequence
  Description of Artificial Sequence: Synthetic oligonucleotide
ccgaguaugc

SEQ ID NO: 933 - RNA, 10 nt, Artificial Sequence
  Description of Artificial Sequence: Synthetic oligonucleotide
ccgaguaagg

SEQ ID NO: 934 - RNA, 10 nt, Artificial Sequence
  Description of Artificial Sequence: Synthetic oligonucleotide
ccgaguacgg

SEQ ID NO: 935 - RNA, 10 nt, Artificial Sequence
  Description of Artificial Sequence: Synthetic oligonucleotide
ccgaguaggg

SEQ ID NO: 936 - RNA, 10 nt, Artificial Sequence
  Description of Artificial Sequence: Synthetic oligonucleotide
gcgaguaugc

SEQ ID NO: 937 - RNA, 10 nt, Artificial Sequence
  Description of Artificial Sequence: Synthetic oligonucleotide
gcgaguaagg

SEQ ID NO: 938 - RNA, 10 nt, Artificial Sequence
  Description of Artificial Sequence: Synthetic oligonucleotide
gcgaguacgg

SEQ ID NO: 939 - RNA, 10 nt, Artificial Sequence
  Description of Artificial Sequence: Synthetic oligonucleotide
gcgaguaggg

SEQ ID NO: 940 - RNA, 10 nt, Artificial Sequence
  Description of Artificial Sequence: Synthetic oligonucleotide
ucgaguaugc

SEQ ID NO: 941 - RNA, 10 nt, Artificial Sequence
  Description of Artificial Sequence: Synthetic oligonucleotide
ucgaguaagg

SEQ ID NO: 942 - RNA, 10 nt, Artificial Sequence
  Description of Artificial Sequence: Synthetic oligonucleotide
ucgaguacgg

SEQ ID NO: 943 - RNA, 10 nt, Artificial Sequence
  Description of Artificial Sequence: Synthetic oligonucleotide
ucgaguaggg

SEQ ID NO: 944 - RNA, 10 nt, Artificial Sequence
  Description of Artificial Sequence: Synthetic oligonucleotide
  modified_base (2)..(2): a, c, u, g, unknown or other
gngaguaugc

SEQ ID NO: 945 - RNA, 10 nt, Artificial Sequence
  Description of Artificial Sequence: Synthetic oligonucleotide
  modified_base (2)..(2): a, c, u, g, unknown or other
gngaguaagg

SEQ ID NO: 946 - RNA, 10 nt, Artificial Sequence
  Description of Artificial Sequence: Synthetic oligonucleotide
  modified_base (2)..(2): a, c, u, g, unknown or other
gngaguacgg

SEQ ID NO: 947 - RNA, 10 nt, Artificial Sequence
  Description of Artificial Sequence: Synthetic oligonucleotide
  modified_base (2)..(2): a, c, u, g, unknown or other
gngaguaggg

SEQ ID NO: 948 - RNA, 10 nt, Artificial Sequence
  Description of Artificial Sequence: Synthetic oligonucleotide
  modified_base (1)..(1): a, c, u, g, unknown or other
nggaguaugc

SEQ ID NO: 949 - RNA, 10 nt, Artificial Sequence
  Description of Artificial Sequence: Synthetic oligonucleotide
  modified_base (1)..(1): a, c, u, g, unknown or other
nggaguaagg

SEQ ID NO: 950 - RNA, 10 nt, Artificial Sequence
  Description of Artificial Sequence: Synthetic oligonucleotide
  modified_base (1)..(1): a, c, u, g, unknown or other
nggaguacgg

SEQ ID NO: 951 - RNA, 10 nt, Artificial Sequence
  Description of Artificial Sequence: Synthetic oligonucleotide
  modified_base (1)..(1): a, c, u, g, unknown or other
nggaguaggg

SEQ ID NO: 952 - RNA, 10 nt, Artificial Sequence
  Description of Artificial Sequence: Synthetic oligonucleotide
aggaguaugc

SEQ ID NO: 953 - RNA, 10 nt, Artificial Sequence
  Description of Artificial Sequence: Synthetic oligonucleotide
aggaguaagg

SEQ ID NO: 954 - RNA, 10 nt, Artificial Sequence
  Description of Artificial Sequence: Synthetic oligonucleotide
aggaguacgg

SEQ ID NO: 955 - RNA, 10 nt, Artificial Sequence
  Description of Artificial Sequence: Synthetic oligonucleotide
aggaguaggg

SEQ ID NO: 956 - RNA, 10 nt, Artificial Sequence
  Description of Artificial Sequence: Synthetic oligonucleotide
cggaguaugc

SEQ ID NO: 957 - RNA, 10 nt, Artificial Sequence
  Description of Artificial Sequence: Synthetic oligonucleotide
cggaguaagg

SEQ ID NO: 958 - RNA, 10 nt, Artificial Sequence
  Description of Artificial Sequence: Synthetic oligonucleotide
cggaguacgg

SEQ ID NO: 959 - RNA, 10 nt, Artificial Sequence
  Description of Artificial Sequence: Synthetic oligonucleotide
cggaguaggg

SEQ ID NO: 960 - RNA, 10 nt, Artificial Sequence
  Description of Artificial Sequence: Synthetic oligonucleotide
gggaguaugc

SEQ ID NO: 961 - RNA, 10 nt, Artificial Sequence
  Description of Artificial Sequence: Synthetic oligonucleotide
gggaguaagg

SEQ ID NO: 962 - RNA, 10 nt, Artificial Sequence
  Description of Artificial Sequence: Synthetic oligonucleotide
gggaguacgg

SEQ ID NO: 963 - RNA, 10 nt, Artificial Sequence
  Description of Artificial Sequence: Synthetic oligonucleotide
gggaguaggg

SEQ ID NO: 964 - RNA, 10 nt, Artificial Sequence
  Description of Artificial Sequence: Synthetic oligonucleotide
uggaguaugc

SEQ ID NO: 965 - RNA, 10 nt, Artificial Sequence
  Description of Artificial Sequence: Synthetic oligonucleotide
uggaguaagg

SEQ ID NO: 966 - RNA, 10 nt, Artificial Sequence
  Description of Artificial Sequence: Synthetic oligonucleotide
uggaguacgg

SEQ ID NO: 967 - RNA, 10 nt, Artificial Sequence
  Description of Artificial Sequence: Synthetic oligonucleotide
uggaguaggg

SEQ ID NO: 968 - RNA, 10 nt, Artificial Sequence
  Description of Artificial Sequence: Synthetic oligonucleotide
  modified_base (2)..(2): a, c, u, g, unknown or other
ungaguaugc

SEQ ID NO: 969 - RNA, 10 nt, Artificial Sequence
  Description of Artificial Sequence: Synthetic oligonucleotide
  modified_base (2)..(2): a, c, u, g, unknown or other
ungaguaagg

SEQ ID NO: 970 - RNA, 10 nt, Artificial Sequence
  Description of Artificial Sequence: Synthetic oligonucleotide
  modified_base (2)..(2): a, c, u, g, unknown or other
ungaguacgg

SEQ ID NO: 971 - RNA, 10 nt, Artificial Sequence
  Description of Artificial Sequence: Synthetic oligonucleotide
  modified_base (2)..(2): a, c, u, g, unknown or other
ungaguaggg

SEQ ID NO: 972 - RNA, 10 nt, Artificial Sequence
  Description of Artificial Sequence: Synthetic oligonucleotide
  modified_base (1)..(1): a, c, u, g, unknown or other
nugaguaugc

SEQ ID NO: 973 - RNA, 10 nt, Artificial Sequence
  Description of Artificial Sequence: Synthetic oligonucleotide
  modified_base (1)..(1): a, c, u, g, unknown or other
nugaguaagg

SEQ ID NO: 974 - RNA, 10 nt, Artificial Sequence
  Description of Artificial Sequence: Synthetic oligonucleotide
  modified_base (1)..(1): a, c, u, g, unknown or other
nugaguacgg

SEQ ID NO: 975 - RNA, 10 nt, Artificial Sequence
  Description of Artificial Sequence: Synthetic oligonucleotide
  modified_base (1)..(1): a, c, u, g, unknown or other
nugaguaggg

SEQ ID NO: 976 - RNA, 10 nt, Artificial Sequence
  Description of Artificial Sequence: Synthetic oligonucleotide
augaguaugc

SEQ ID NO: 977 - RNA, 10 nt, Artificial Sequence
  Description of Artificial Sequence: Synthetic oligonucleotide
augaguaagg

SEQ ID NO: 978 - RNA, 10 nt, Artificial Sequence
  Description of Artificial Sequence: Synthetic oligonucleotide
augaguacgg

SEQ ID NO: 979 - RNA, 10 nt, Artificial Sequence
  Description of Artificial Sequence: Synthetic oligonucleotide
augaguaggg

SEQ ID NO: 980 - RNA, 10 nt, Artificial Sequence
  Description of Artificial Sequence: Synthetic oligonucleotide
cugaguaugc

SEQ ID NO: 981 - RNA, 10 nt, Artificial Sequence
  Description of Artificial Sequence: Synthetic oligonucleotide
cugaguaagg

SEQ ID NO: 982 - RNA, 10 nt, Artificial Sequence
  Description of Artificial Sequence: Synthetic oligonucleotide
cugaguacgg

SEQ ID NO: 983 - RNA, 10 nt, Artificial Sequence
  Description of Artificial Sequence: Synthetic oligonucleotide
cugaguaggg

SEQ ID NO: 984 - RNA, 10 nt, Artificial Sequence
  Description of Artificial Sequence: Synthetic oligonucleotide
gugaguaugc

SEQ ID NO: 985 - RNA, 10 nt, Artificial Sequence
  Description of Artificial Sequence: Synthetic oligonucleotide
gugaguaagg

SEQ ID NO: 986 - RNA, 10 nt, Artificial Sequence
  Description of Artificial Sequence: Synthetic oligonucleotide
gugaguacgg

SEQ ID NO: 987 - RNA, 10 nt, Artificial Sequence
  Description of Artificial Sequence: Synthetic oligonucleotide
gugaguaggg

SEQ ID NO: 988 - RNA, 10 nt, Artificial Sequence
  Description of Artificial Sequence: Synthetic oligonucleotide
uugaguaugc

SEQ ID NO: 989 - RNA, 10 nt, Artificial Sequence
  Description of Artificial Sequence: Synthetic oligonucleotide
uugaguaagg

SEQ ID NO: 990 - RNA, 10 nt, Artificial Sequence
  Description of Artificial Sequence: Synthetic oligonucleotide
uugaguacgg

SEQ ID NO: 991 - RNA, 10 nt, Artificial Sequence
  Description of Artificial Sequence: Synthetic oligonucleotide
uugaguaggg

SEQ ID NO: 992 - RNA, 10 nt, Artificial Sequence
  Description of Artificial Sequence: Synthetic oligonucleotide
  modified_base (2)..(2): a, c, u, g, unknown or other
angaguaugg

SEQ ID NO: 993 - RNA, 10 nt, Artificial Sequence
  Description of Artificial Sequence: Synthetic oligonucleotide
  modified_base (2)..(2): a, c, u, g, unknown or other
angaguaagu

SEQ ID NO: 994 - RNA, 10 nt, Artificial Sequence
  Description of Artificial Sequence: Synthetic oligonucleotide
  modified_base (2)..(2): a, c, u, g, unknown or other
angaguacgu

SEQ ID NO: 995 - RNA, 10 nt, Artificial Sequence
  Description of Artificial Sequence: Synthetic oligonucleotide
  modified_base (2)..(2): a, c, u, g, unknown or other
angaguaggu

SEQ ID NO: 996 - RNA, 10 nt, Artificial Sequence
  Description of Artificial Sequence: Synthetic oligonucleotide
  modified_base (1)..(1): a, c, u, g, unknown or other
nagaguaugg

SEQ ID NO: 997 - RNA, 10 nt, Artificial Sequence
  Description of Artificial Sequence: Synthetic oligonucleotide
  modified_base (1)..(1): a, c, u, g, unknown or other
nagaguaagu

SEQ ID NO: 998 - RNA, 10 nt, Artificial Sequence
  Description of Artificial Sequence: Synthetic oligonucleotide
  modified_base (1)..(1): a, c, u, g, unknown or other
nagaguacgu

SEQ ID NO: 999 - RNA, 10 nt, Artificial Sequence
  Description of Artificial Sequence: Synthetic oligonucleotide
  modified_base (1)..(1): a, c, u, g, unknown or other
nagaguaggu

SEQ ID NO: 1000 - RNA, 10 nt, Artificial Sequence
  Description of Artificial Sequence: Synthetic oligonucleotide
aagaguaugg

SEQ ID NO: 1001 - RNA, 10 nt, Artificial Sequence
  Description of Artificial Sequence: Synthetic oligonucleotide
aagaguaagu

SEQ ID NO: 1002 - RNA, 10 nt, Artificial Sequence
  Description of Artificial Sequence: Synthetic oligonucleotide
aagaguacgu

SEQ ID NO: 1003 - RNA, 10 nt, Artificial Sequence
  Description of Artificial Sequence: Synthetic oligonucleotide
aagaguaggu

SEQ ID NO: 1004 - RNA, 10 nt, Artificial Sequence
  Description of Artificial Sequence: Synthetic oligonucleotide
cagaguaugg

SEQ ID NO: 1005 - RNA, 10 nt, Artificial Sequence
  Description of Artificial Sequence: Synthetic oligonucleotide
cagaguaagu

SEQ ID NO: 1006 - RNA, 10 nt, Artificial Sequence
  Description of Artificial Sequence: Synthetic oligonucleotide
cagaguacgu

SEQ ID NO: 1007 - RNA, 10 nt, Artificial Sequence
  Description of Artificial Sequence: Synthetic oligonucleotide
cagaguaggu

SEQ ID NO: 1008 - RNA, 10 nt, Artificial Sequence
  Description of Artificial Sequence: Synthetic oligonucleotide
gagaguaugg

SEQ ID NO: 1009 - RNA, 10 nt, Artificial Sequence
  Description of Artificial Sequence: Synthetic oligonucleotide
gagaguaagu

SEQ ID NO: 1010 - RNA, 10 nt, Artificial Sequence
  Description of Artificial Sequence: Synthetic oligonucleotide
gagaguacgu

SEQ ID NO: 1011 - RNA, 10 nt, Artificial Sequence
  Description of Artificial Sequence: Synthetic oligonucleotide
gagaguaggu

SEQ ID NO: 1012 - RNA, 10 nt, Artificial Sequence
  Description of Artificial Sequence: Synthetic oligonucleotide
uagaguaugg

SEQ ID NO: 1013 - RNA, 10 nt, Artificial Sequence
  Description of Artificial Sequence: Synthetic oligonucleotide
uagaguaagu

SEQ ID NO: 1014 - RNA, 10 nt, Artificial Sequence
  Description of Artificial Sequence: Synthetic oligonucleotide
uagaguacgu

SEQ ID NO: 1015 - RNA, 10 nt, Artificial Sequence
  Description of Artificial Sequence: Synthetic oligonucleotide
uagaguaggu

SEQ ID NO: 1016 - RNA, 10 nt, Artificial Sequence
  Description of Artificial Sequence: Synthetic oligonucleotide
  modified_base (2)..(2): a, c, u, g, unknown or other
cngaguaugg

SEQ ID NO: 1017 - RNA, 10 nt, Artificial Sequence
  Description of Artificial Sequence: Synthetic oligonucleotide
  modified_base (2)..(2): a, c, u, g, unknown or other
cngaguaagu

SEQ ID NO: 1018 - RNA, 10 nt, Artificial Sequence
  Description of Artificial Sequence: Synthetic oligonucleotide
  modified_base (2)..(2): a, c, u, g, unknown or other
cngaguacgu

SEQ ID NO: 1019 - RNA, 10 nt, Artificial Sequence
  Description of Artificial Sequence: Synthetic oligonucleotide
  modified_base (2)..(2): a, c, u, g, unknown or other
cngaguaggu

SEQ ID NO: 1020 - RNA, 10 nt, Artificial Sequence
  Description of Artificial Sequence: Synthetic oligonucleotide
  modified_base (1)..(1): a, c, u, g, unknown or other
ncgaguaugg

SEQ ID NO: 1021 - RNA, 10 nt, Artificial Sequence
  Description of Artificial Sequence: Synthetic oligonucleotide
  modified_base (1)..(1): a, c, u, g, unknown or other
ncgaguaagu

SEQ ID NO: 1022 - RNA, 10 nt, Artificial Sequence
  Description of Artificial Sequence: Synthetic oligonucleotide
  modified_base (1)..(1): a, c, u, g, unknown or other
ncgaguacgu

SEQ ID NO: 1023 - RNA, 10 nt, Artificial Sequence
  Description of Artificial Sequence: Synthetic oligonucleotide
  modified_base (1)..(1): a, c, u, g, unknown or other
ncgaguaggu

SEQ ID NO: 1024 - RNA, 10 nt, Artificial Sequence
  Description of Artificial Sequence: Synthetic oligonucleotide
acgaguaugg

SEQ ID NO: 1025 - RNA, 10 nt, Artificial Sequence
  Description of Artificial Sequence: Synthetic oligonucleotide
acgaguaagu

SEQ ID NO: 1026 - RNA, 10 nt, Artificial Sequence
  Description of Artificial Sequence: Synthetic oligonucleotide
acgaguacgu

SEQ ID NO: 1027 - RNA, 10 nt, Artificial Sequence
  Description of Artificial Sequence: Synthetic oligonucleotide
acgaguaggu

SEQ ID NO: 1028 - RNA, 10 nt, Artificial Sequence
  Description of Artificial Sequence: Synthetic oligonucleotide
ccgaguaugg

SEQ ID NO: 1029 - RNA, 10 nt, Artificial Sequence
  Description of Artificial Sequence: Synthetic oligonucleotide
ccgaguaagu

SEQ ID NO: 1030 - RNA, 10 nt, Artificial Sequence
  Description of Artificial Sequence: Synthetic oligonucleotide
ccgaguacgu

SEQ ID NO: 1031 - RNA, 10 nt, Artificial Sequence
  Description of Artificial Sequence: Synthetic oligonucleotide
ccgaguaggu

SEQ ID NO: 1032 - RNA, 10 nt, Artificial Sequence
  Description of Artificial Sequence: Synthetic oligonucleotide
gcgaguaugg

SEQ ID NO: 1033 - RNA, 10 nt, Artificial Sequence
  Description of Artificial Sequence: Synthetic oligonucleotide
gcgaguaagu

SEQ ID NO: 1034 - RNA, 10 nt, Artificial Sequence
  Description of Artificial Sequence: Synthetic oligonucleotide
gcgaguacgu

SEQ ID NO: 1035 - RNA, 10 nt, Artificial Sequence
  Description of Artificial Sequence: Synthetic oligonucleotide
gcgaguaggu

SEQ ID NO: 1036 - RNA, 10 nt, Artificial Sequence
  Description of Artificial Sequence: Synthetic oligonucleotide
ucgaguaugg

SEQ ID NO: 1037 - RNA, 10 nt, Artificial Sequence
  Description of Artificial Sequence: Synthetic oligonucleotide
ucgaguaagu

SEQ ID NO: 1038 - RNA, 10 nt, Artificial Sequence
  Description of Artificial Sequence: Synthetic oligonucleotide
ucgaguacgu

SEQ ID NO: 1039 - RNA, 10 nt, Artificial Sequence
  Description of Artificial Sequence: Synthetic oligonucleotide
ucgaguaggu

SEQ ID NO: 1040 - RNA, 10 nt, Artificial Sequence
  Description of Artificial Sequence: Synthetic oligonucleotide
  modified_base (2)..(2): a, c, u, g, unknown or other
gngaguaugg

SEQ ID NO: 1041 - RNA, 10 nt, Artificial Sequence
  Description of Artificial Sequence: Synthetic oligonucleotide
  modified_base (2)..(2): a, c, u, g, unknown or other
gngaguaagu

SEQ ID NO: 1042 - RNA, 10 nt, Artificial Sequence
  Description of Artificial Sequence: Synthetic oligonucleotide
  modified_base (2)..(2): a, c, u, g, unknown or other
gngaguacgu

SEQ ID NO: 1043 - RNA, 10 nt, Artificial Sequence
  Description of Artificial Sequence: Synthetic oligonucleotide
  modified_base (2)..(2): a, c, u, g, unknown or other
gngaguaggu

SEQ ID NO: 1044 - RNA, 10 nt, Artificial Sequence
  Description of Artificial Sequence: Synthetic oligonucleotide
  modified_base (1)..(1): a, c, u, g, unknown or other
nggaguaugg

SEQ ID NO: 1045 - RNA, 10 nt, Artificial Sequence
  Description of Artificial Sequence: Synthetic oligonucleotide
  modified_base (1)..(1): a, c, u, g, unknown or other
nggaguaagu

SEQ ID NO: 1046 - RNA, 10 nt, Artificial Sequence
  Description of Artificial Sequence: Synthetic oligonucleotide
  modified_base (1)..(1): a, c, u, g, unknown or other
nggaguacgu

SEQ ID NO: 1047 - RNA, 10 nt, Artificial Sequence
  Description of Artificial Sequence: Synthetic oligonucleotide
  modified_base (1)..(1): a, c, u, g, unknown or other
nggaguaggu

SEQ ID NO: 1048 - RNA, 10 nt, Artificial Sequence
  Description of Artificial Sequence: Synthetic oligonucleotide
aggaguaugg

SEQ ID NO: 1049 - RNA, 10 nt, Artificial Sequence
  Description of Artificial Sequence: Synthetic oligonucleotide
aggaguaagu

SEQ ID NO: 1050 - RNA, 10 nt, Artificial Sequence
  Description of Artificial Sequence: Synthetic oligonucleotide
aggaguacgu

SEQ ID NO: 1051 - RNA, 10 nt, Artificial Sequence
  Description of Artificial Sequence: Synthetic oligonucleotide
aggaguaggu

SEQ ID NO: 1052 - RNA, 10 nt, Artificial Sequence
  Description of Artificial Sequence: Synthetic oligonucleotide
cggaguaugg

SEQ ID NO: 1053 - RNA, 10 nt, Artificial Sequence
  Description of Artificial Sequence: Synthetic oligonucleotide
cggaguaagu

SEQ ID NO: 1054 - RNA, 10 nt, Artificial Sequence
  Description of Artificial Sequence: Synthetic oligonucleotide
cggaguacgu

SEQ ID NO: 1055 - RNA, 10 nt, Artificial Sequence
  Description of Artificial Sequence: Synthetic oligonucleotide
cggaguaggu

SEQ ID NO: 1056 - RNA, 10 nt, Artificial Sequence
  Description of Artificial Sequence: Synthetic oligonucleotide
gggaguaugg

SEQ ID NO: 1057 - RNA, 10 nt, Artificial Sequence
  Description of Artificial Sequence: Synthetic oligonucleotide
gggaguaagu

SEQ ID NO: 1058 - RNA, 10 nt, Artificial Sequence
  Description of Artificial Sequence: Synthetic oligonucleotide
gggaguacgu

SEQ ID NO: 1059 - RNA, 10 nt, Artificial Sequence
  Description of Artificial Sequence: Synthetic oligonucleotide
gggaguaggu

SEQ ID NO: 1060 - RNA, 10 nt, Artificial Sequence
  Description of Artificial Sequence: Synthetic oligonucleotide
uggaguaugg

SEQ ID NO: 1061 - RNA, 10 nt, Artificial Sequence
  Description of Artificial Sequence: Synthetic oligonucleotide
uggaguaagu

SEQ ID NO: 1062 - RNA, 10 nt, Artificial Sequence
  Description of Artificial Sequence: Synthetic oligonucleotide
uggaguacgu

SEQ ID NO: 1063 - RNA, 10 nt, Artificial Sequence
  Description of Artificial Sequence: Synthetic oligonucleotide
uggaguaggu

SEQ ID NO: 1064 - RNA, 10 nt, Artificial Sequence
  Description of Artificial Sequence: Synthetic oligonucleotide
  modified_base (2)..(2): a, c, u, g, unknown or other
ungaguaugg

SEQ ID NO: 1065 - RNA, 10 nt, Artificial Sequence
  Description of Artificial Sequence: Synthetic oligonucleotide
  modified_base (2)..(2): a, c, u, g, unknown or other
ungaguaagu

SEQ ID NO: 1066 - RNA, 10 nt, Artificial Sequence
  Description of Artificial Sequence: Synthetic oligonucleotide
  modified_base (2)..(2): a, c, u, g, unknown or other
ungaguacgu

SEQ ID NO: 1067 - RNA, 10 nt, Artificial Sequence
  Description of Artificial Sequence: Synthetic oligonucleotide
  modified_base (2)..(2): a, c, u, g, unknown or other
ungaguaggu

SEQ ID NO: 1068 - RNA, 10 nt, Artificial Sequence
  Description of Artificial Sequence: Synthetic oligonucleotide
  modified_base (1)..(1): a, c, u, g, unknown or other
nugaguaugg

SEQ ID NO: 1069 - RNA, 10 nt, Artificial Sequence
  Description of Artificial Sequence: Synthetic oligonucleotide
  modified_base (1)..(1): a, c, u, g, unknown or other
nugaguaagu

SEQ ID NO: 1070 - RNA, 10 nt, Artificial Sequence
  Description of Artificial Sequence: Synthetic oligonucleotide
  modified_base (1)..(1): a, c, u, g, unknown or other
nugaguacgu

SEQ ID NO: 1071 - RNA, 10 nt, Artificial Sequence
  Description of Artificial Sequence: Synthetic oligonucleotide
  modified_base (1)..(1): a, c, u, g, unknown or other
nugaguaggu

SEQ ID NO: 1072 - RNA, 10 nt, Artificial Sequence
  Description of Artificial Sequence: Synthetic oligonucleotide
augaguaugg

SEQ ID NO: 1073 - RNA, 10 nt, Artificial Sequence
  Description of Artificial Sequence: Synthetic oligonucleotide
augaguaagu

SEQ ID NO: 1074 - RNA, 10 nt, Artificial Sequence
  Description of Artificial Sequence: Synthetic oligonucleotide
augaguacgu

SEQ ID NO: 1075 - RNA, 10 nt, Artificial Sequence
  Description of Artificial Sequence: Synthetic oligonucleotide
augaguaggu

SEQ ID NO: 1076 - RNA, 10 nt, Artificial Sequence
  Description of Artificial Sequence: Synthetic oligonucleotide
cugaguaugg

SEQ ID NO: 1077 - RNA, 10 nt, Artificial Sequence
  Description of Artificial Sequence: Synthetic oligonucleotide
cugaguaagu

SEQ ID NO: 1078 - RNA, 10 nt, Artificial Sequence
  Description of Artificial Sequence: Synthetic oligonucleotide
cugaguacgu

SEQ ID NO: 1079 - RNA, 10 nt, Artificial Sequence
  Description of Artificial Sequence: Synthetic oligonucleotide
cugaguaggu

SEQ ID NO: 1080 - RNA, 10 nt, Artificial Sequence
  Description of Artificial Sequence: Synthetic oligonucleotide
gugaguaugg

SEQ ID NO: 1081 - RNA, 10 nt, Artificial Sequence
  Description of Artificial Sequence: Synthetic oligonucleotide
gugaguaagu

SEQ ID NO: 1082 - RNA, 10 nt, Artificial Sequence
  Description of Artificial Sequence: Synthetic oligonucleotide
gugaguacgu

SEQ ID NO: 1083 - RNA, 10 nt, Artificial Sequence
  Description of Artificial Sequence: Synthetic oligonucleotide
gugaguaggu

SEQ ID NO: 1084 - RNA, 10 nt, Artificial Sequence
  Description of Artificial Sequence: Synthetic oligonucleotide
uugaguaugg

SEQ ID NO: 1085 - RNA, 10 nt, Artificial Sequence
  Description of Artificial Sequence: Synthetic oligonucleotide
uugaguaagu

SEQ ID NO: 1086 - RNA, 10 nt, Artificial Sequence
  Description of Artificial Sequence: Synthetic oligonucleotide
uugaguacgu

SEQ ID NO: 1087 - RNA, 10 nt, Artificial Sequence
  Description of Artificial Sequence: Synthetic oligonucleotide
uugaguaggu

SEQ ID NO: 1088 - RNA, 10 nt, Artificial Sequence
  Description of Artificial Sequence: Synthetic oligonucleotide
  modified_base (2)..(2): a, c, u, g, unknown or other
angaguaugu

SEQ ID NO: 1089 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
angaguanga

SEQ ID NO: 1090 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
angaguangc

SEQ ID NO: 1091 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
angaguangg

SEQ ID NO: 1092 - RNA, 10 nt, Artificial Sequence
  Description of Artificial Sequence: Synthetic oligonucleotide
  modified_base (1)..(1): a, c, u, g, unknown or other
nagaguaugu

SEQ ID NO: 1093 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
nagaguanga

SEQ ID NO: 1094 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
nagaguangc

SEQ ID NO: 1095 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
nagaguangg

SEQ ID NO: 1096 - RNA, 10 nt, Artificial Sequence
  Description of Artificial Sequence: Synthetic oligonucleotide
aagaguaugu

SEQ ID NO: 1097 - RNA, 10 nt, Artificial Sequence
  Description of Artificial Sequence: Synthetic oligonucleotide
  modified_base (8)..(8): a, c, u, g, unknown or other
aagaguanga

SEQ ID NO: 1098 - RNA, 10 nt, Artificial Sequence
  Description of Artificial Sequence: Synthetic oligonucleotide
  modified_base (8)..(8): a, c, u, g, unknown or other
aagaguangc

SEQ ID NO: 1099 - RNA, 10 nt, Artificial Sequence
  Description of Artificial Sequence: Synthetic oligonucleotide
  modified_base (8)..(8): a, c, u, g, unknown or other
aagaguangg

SEQ ID NO: 1100 - RNA, 10 nt, Artificial Sequence
  Description of Artificial Sequence: Synthetic oligonucleotide
cagaguaugu

SEQ ID NO: 1101 - RNA, 10 nt, Artificial Sequence
  Description of Artificial Sequence: Synthetic oligonucleotide
  modified_base (8)..(8): a, c, u, g, unknown or other
cagaguanga

SEQ ID NO: 1102 - RNA, 10 nt, Artificial Sequence
  Description of Artificial Sequence: Synthetic oligonucleotide
  modified_base (8)..(8): a, c, u, g, unknown or other
cagaguangc

SEQ ID NO: 1103 - RNA, 10 nt, Artificial Sequence
  Description of Artificial Sequence: Synthetic oligonucleotide
  modified_base (8)..(8): a, c, u, g, unknown or other
cagaguangg

SEQ ID NO: 1104 - RNA, 10 nt, Artificial Sequence
  Description of Artificial Sequence: Synthetic oligonucleotide
gagaguaugu

SEQ ID NO: 1105 - RNA, 10 nt, Artificial Sequence
  Description of Artificial Sequence: Synthetic oligonucleotide
  modified_base (8)..(8): a, c, u, g, unknown or other
gagaguanga

SEQ ID NO: 1106 - RNA, 10 nt, Artificial Sequence
  Description of Artificial Sequence: Synthetic oligonucleotide
  modified_base (8)..(8): a, c, u, g, unknown or other
gagaguangc

SEQ ID NO: 1107 - RNA, 10 nt, Artificial Sequence
  Description of Artificial Sequence: Synthetic oligonucleotide
  modified_base (8)..(8): a, c, u, g, unknown or other
gagaguangg

SEQ ID NO: 1108 - RNA, 10 nt, Artificial Sequence
  Description of Artificial Sequence: Synthetic oligonucleotide
uagaguaugu

SEQ ID NO: 1109 - RNA, 10 nt, Artificial Sequence
  Description of Artificial Sequence: Synthetic oligonucleotide
  modified_base (8)..(8): a, c, u, g, unknown or other
uagaguanga

SEQ ID NO: 1110 - RNA, 10 nt, Artificial Sequence
  Description of Artificial Sequence: Synthetic oligonucleotide
  modified_base (8)..(8): a, c, u, g, unknown or other
uagaguangc

SEQ ID NO: 1111 - RNA, 10 nt, Artificial Sequence
  Description of Artificial Sequence: Synthetic oligonucleotide
  modified_base (8)..(8): a, c, u, g, unknown or other
uagaguangg

SEQ ID NO: 1112 - RNA, 10 nt, Artificial Sequence
  Description of Artificial Sequence: Synthetic oligonucleotide
  modified_base (2)..(2): a, c, u, g, unknown or other
cngaguaugu

SEQ ID NO: 1113 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
cngaguanga

SEQ ID NO: 1114 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
cngaguangc

SEQ ID NO: 1115 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
cngaguangg

SEQ ID NO: 1116 - RNA, 10 nt, Artificial Sequence
  Description of Artificial Sequence: Synthetic oligonucleotide
  modified_base (1)..(1): a, c, u, g, unknown or other
ncgaguaugu

SEQ ID NO: 1117 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
ncgaguanga

SEQ ID NO: 1118 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
ncgaguangc

SEQ ID NO: 1119 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
ncgaguangg

SEQ ID NO: 1120 - RNA, 10 nt, Artificial Sequence
  Description of Artificial Sequence: Synthetic oligonucleotide
acgaguaugu

SEQ ID NO: 1121 - RNA, 10 nt, Artificial Sequence
  Description of Artificial Sequence: Synthetic oligonucleotide
  modified_base (8)..(8): a, c, u, g, unknown or other
acgaguanga

SEQ ID NO: 1122 - RNA, 10 nt, Artificial Sequence
  Description of Artificial Sequence: Synthetic oligonucleotide
  modified_base (8)..(8): a, c, u, g, unknown or other
acgaguangc

SEQ ID NO: 1123 - RNA, 10 nt, Artificial Sequence
  Description of Artificial Sequence: Synthetic oligonucleotide
  modified_base (8)..(8): a, c, u, g, unknown or other
acgaguangg

SEQ ID NO: 1124 - RNA, 10 nt, Artificial Sequence
  Description of Artificial Sequence: Synthetic oligonucleotide
ccgaguaugu

SEQ ID NO: 1125 - RNA, 10 nt, Artificial Sequence
  Description of Artificial Sequence: Synthetic oligonucleotide
  modified_base (8)..(8): a, c, u, g, unknown or other
ccgaguanga

SEQ ID NO: 1126 - RNA, 10 nt, Artificial Sequence
  Description of Artificial Sequence: Synthetic oligonucleotide
  modified_base (8)..(8): a, c, u, g, unknown or other
ccgaguangc

SEQ ID NO: 1127 - RNA, 10 nt, Artificial Sequence
  Description of Artificial Sequence: Synthetic oligonucleotide
  modified_base (8)..(8): a, c, u, g, unknown or other
ccgaguangg

SEQ ID NO: 1128 - RNA, 10 nt, Artificial Sequence
  Description of Artificial Sequence: Synthetic oligonucleotide
gcgaguaugu

SEQ ID NO: 1129 - RNA, 10 nt, Artificial Sequence
  Description of Artificial Sequence: Synthetic oligonucleotide
  modified_base (8)..(8): a, c, u, g, unknown or other
gcgaguanga

SEQ ID NO: 1130 - RNA, 10 nt, Artificial Sequence
  Description of Artificial Sequence: Synthetic oligonucleotide
  modified_base (8)..(8): a, c, u, g, unknown or other
gcgaguangc

SEQ ID NO: 1131 - RNA, 10 nt, Artificial Sequence
  Description of Artificial Sequence: Synthetic oligonucleotide
  modified_base (8)..(8): a, c, u, g, unknown or other
gcgaguangg

SEQ ID NO: 1132 - RNA, 10 nt, Artificial Sequence
  Description of Artificial Sequence: Synthetic oligonucleotide
ucgaguaugu

SEQ ID NO: 1133 - RNA, 10 nt, Artificial Sequence
  Description of Artificial Sequence: Synthetic oligonucleotide
  modified_base (8)..(8): a, c, u, g, unknown or other
ucgaguanga

SEQ ID NO: 1134 - RNA, 10 nt, Artificial Sequence
  Description of Artificial Sequence: Synthetic oligonucleotide
  modified_base (8)..(8): a, c, u, g, unknown or other
ucgaguangc

SEQ ID NO: 1135 - RNA, 10 nt, Artificial Sequence
  Description of Artificial Sequence: Synthetic oligonucleotide
  modified_base (8)..(8): a, c, u, g, unknown or other
ucgaguangg

SEQ ID NO: 1136 - RNA, 10 nt, Artificial Sequence
  Description of Artificial Sequence: Synthetic oligonucleotide
  modified_base (2)..(2): a, c, u, g, unknown or other
gngaguaugu

SEQ ID NO: 1137 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
gngaguanga

SEQ ID NO: 1138 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
gngaguangc

SEQ ID NO: 1139 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
gngaguangg

SEQ ID NO: 1140 - RNA, 10 nt, Artificial Sequence
  Description of Artificial Sequence: Synthetic oligonucleotide
  modified_base (1)..(1): a, c, u, g, unknown or other
nggaguaugu

SEQ ID NO: 1141 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
nggaguanga

SEQ ID NO: 1142 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
nggaguangc

SEQ ID NO: 1143 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
nggaguangg

SEQ ID NO: 1144 - RNA, 10 nt, Artificial Sequence
  Description of Artificial Sequence: Synthetic oligonucleotide
aggaguaugu

SEQ ID NO: 1145 - RNA, 10 nt, Artificial Sequence
  Description of Artificial Sequence: Synthetic oligonucleotide
  modified_base (8)..(8): a, c, u, g, unknown or other
aggaguanga

SEQ ID NO: 1146 - RNA, 10 nt, Artificial Sequence
  Description of Artificial Sequence: Synthetic oligonucleotide
  modified_base (8)..(8): a, c, u, g, unknown or other
aggaguangc

SEQ ID NO: 1147 - RNA, 10 nt, Artificial Sequence
  Description of Artificial Sequence: Synthetic oligonucleotide
  modified_base (8)..(8): a, c, u, g, unknown or other
aggaguangg

SEQ ID NO: 1148 - RNA, 10 nt, Artificial Sequence
  Description of Artificial Sequence: Synthetic oligonucleotide
cggaguaugu

SEQ ID NO: 1149 - RNA, 10 nt, Artificial Sequence
  Description of Artificial Sequence: Synthetic oligonucleotide
  modified_base (8)..(8): a, c, u, g, unknown or other
cggaguanga

SEQ ID NO: 1150 - RNA, 10 nt, Artificial Sequence
  Description of Artificial Sequence: Synthetic oligonucleotide
  modified_base (8)..(8): a, c, u, g, unknown or other
cggaguangc

SEQ ID NO: 1151 - RNA, 10 nt, Artificial Sequence
  Description of Artificial Sequence: Synthetic oligonucleotide
  modified_base (8)..(8): a, c, u, g, unknown or other
cggaguangg

SEQ ID NO: 1152 - RNA, 10 nt, Artificial Sequence
  Description of Artificial Sequence: Synthetic oligonucleotide
gggaguaugu

SEQ ID NO: 1153 - RNA, 10 nt, Artificial Sequence
  Description of Artificial Sequence: Synthetic oligonucleotide
  modified_base (8)..(8): a, c, u, g, unknown or other
gggaguanga

SEQ ID NO: 1154 - RNA, 10 nt, Artificial Sequence
  Description of Artificial Sequence: Synthetic oligonucleotide
  modified_base (8)..(8): a, c, u, g, unknown or other
gggaguangc

SEQ ID NO: 1155 - RNA, 10 nt, Artificial Sequence
  Description of Artificial Sequence: Synthetic oligonucleotide
  modified_base (8)..(8): a, c, u, g, unknown or other
gggaguangg

SEQ ID NO: 1156 - RNA, 10 nt, Artificial Sequence
  Description of Artificial Sequence: Synthetic oligonucleotide
uggaguaugu

SEQ ID NO: 1157 - RNA, 10 nt, Artificial Sequence
  Description of Artificial Sequence: Synthetic oligonucleotide
  modified_base (8)..(8): a, c, u, g, unknown or other
uggaguanga

SEQ ID NO: 1158 - RNA, 10 nt, Artificial Sequence
  Description of Artificial Sequence: Synthetic oligonucleotide
  modified_base (8)..(8): a, c, u, g, unknown or other
uggaguangc

SEQ ID NO: 1159 - RNA, 10 nt, Artificial Sequence
  Description of Artificial Sequence: Synthetic oligonucleotide
  modified_base (8)..(8): a, c, u, g, unknown or other
uggaguangg

SEQ ID NO: 1160 - RNA, 10 nt, Artificial Sequence
  Description of Artificial Sequence: Synthetic oligonucleotide
  modified_base (2)..(2): a, c, u, g, unknown or other
ungaguaugu

SEQ ID NO: 1161 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
ungaguanga

SEQ ID NO: 1162 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
ungaguangc

SEQ ID NO: 1163 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
ungaguangg

SEQ ID NO: 1164 - RNA, 10 nt, Artificial Sequence
  Description of Artificial Sequence: Synthetic oligonucleotide
  modified_base (1)..(1): a, c, u, g, unknown or other
nugaguaugu

SEQ ID NO: 1165 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
nugaguanga

SEQ ID NO: 1166 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
nugaguangc

SEQ ID NO: 1167 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
nugaguangg

SEQ ID NO: 1168 - RNA, 10 nt, Artificial Sequence
  Description of Artificial Sequence: Synthetic oligonucleotide
augaguaugu

SEQ ID NO: 1169 - RNA, 10 nt, Artificial Sequence
  Description of Artificial Sequence: Synthetic oligonucleotide
  modified_base (8)..(8): a, c, u, g, unknown or other
augaguanga

SEQ ID NO: 1170 - RNA, 10 nt, Artificial Sequence
  Description of Artificial Sequence: Synthetic oligonucleotide
  modified_base (8)..(8): a, c, u, g, unknown or other
augaguangc

SEQ ID NO: 1171 - RNA, 10 nt, Artificial Sequence
  Description of Artificial Sequence: Synthetic oligonucleotide
  modified_base (8)..(8): a, c, u, g, unknown or other
augaguangg

SEQ ID NO: 1172 - RNA, 10 nt, Artificial Sequence
  Description of Artificial Sequence: Synthetic oligonucleotide
cugaguaugu

SEQ ID NO: 1173 - RNA, 10 nt, Artificial Sequence
  Description of Artificial Sequence: Synthetic oligonucleotide
  modified_base (8)..(8): a, c, u, g, unknown or other
cugaguanga

SEQ ID NO: 1174 - RNA, 10 nt, Artificial Sequence
  Description of Artificial Sequence: Synthetic oligonucleotide
  modified_base (8)..(8): a, c, u, g, unknown or other
cugaguangc

SEQ ID NO: 1175 - RNA, 10 nt, Artificial Sequence
  Description of Artificial Sequence: Synthetic oligonucleotide
  modified_base (8)..(8): a, c, u, g, unknown or other
cugaguangg

SEQ ID NO: 1176 - RNA, 10 nt, Artificial Sequence
  Description of Artificial Sequence: Synthetic oligonucleotide
gugaguaugu

SEQ ID NO: 1177 - RNA, 10 nt, Artificial Sequence
  Description of Artificial Sequence: Synthetic oligonucleotide
  modified_base (8)..(8): a, c, u, g, unknown or other
gugaguanga

SEQ ID NO: 1178 - RNA, 10 nt, Artificial Sequence
  Description of Artificial Sequence: Synthetic oligonucleotide
  modified_base (8)..(8): a, c, u, g, unknown or other
gugaguangc

SEQ ID NO: 1179 - RNA, 10 nt, Artificial Sequence
  Description of Artificial Sequence: Synthetic oligonucleotide
  modified_base (8)..(8): a, c, u, g, unknown or other
gugaguangg

SEQ ID NO: 1180 - RNA, 10 nt, Artificial Sequence
  Description of Artificial Sequence: Synthetic oligonucleotide
uugaguaugu

SEQ ID NO: 1181 - RNA, 10 nt, Artificial Sequence
  Description of Artificial Sequence: Synthetic oligonucleotide
  modified_base (8)..(8): a, c, u, g, unknown or other
uugaguanga

SEQ ID NO: 1182 - RNA, 10 nt, Artificial Sequence
  Description of Artificial Sequence: Synthetic oligonucleotide
  modified_base (8)..(8): a, c, u, g, unknown or other
uugaguangc

SEQ ID NO: 1183 - RNA, 10 nt, Artificial Sequence
  Description of Artificial Sequence: Synthetic oligonucleotide
  modified_base (8)..(8): a, c, u, g, unknown or other
uugaguangg

SEQ ID NO: 1184 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
angaguangu

SEQ ID NO: 1185 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
  modified_base (10)..(10): a, c, u, g, unknown or other
angagugngn

SEQ ID NO: 1186 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
angagugagn

SEQ ID NO: 1187 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
angagugcgn

SEQ ID NO: 1188 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
nagaguangu

SEQ ID NO: 1189 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
  modified_base (10)..(10): a, c, u, g, unknown or other
nagagugngn

SEQ ID NO: 1190 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
nagagugagn

SEQ ID NO: 1191 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
nagagugcgn

SEQ ID NO: 1192 - RNA, 10 nt, Artificial Sequence
  Description of Artificial Sequence: Synthetic oligonucleotide
  modified_base (8)..(8): a, c, u, g, unknown or other
aagaguangu

SEQ ID NO: 1193 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
aagagugngn

SEQ ID NO: 1194 - RNA, 10 nt, Artificial Sequence
  Description of Artificial Sequence: Synthetic oligonucleotide
  modified_base (10)..(10): a, c, u, g, unknown or other
aagagugagn

SEQ ID NO: 1195 - RNA, 10 nt, Artificial Sequence
  Description of Artificial Sequence: Synthetic oligonucleotide
  modified_base (10)..(10): a, c, u, g, unknown or other
aagagugcgn

SEQ ID NO: 1196 - RNA, 10 nt, Artificial Sequence
  Description of Artificial Sequence: Synthetic oligonucleotide
  modified_base (8)..(8): a, c, u, g, unknown or other
cagaguangu

SEQ ID NO: 1197 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
cagagugngn

SEQ ID NO: 1198 - RNA, 10 nt, Artificial Sequence
  Description of Artificial Sequence: Synthetic oligonucleotide
  modified_base (10)..(10): a, c, u, g, unknown or other
cagagugagn

SEQ ID NO: 1199 - RNA, 10 nt, Artificial Sequence
  Description of Artificial Sequence: Synthetic oligonucleotide
  modified_base (10)..(10): a, c, u, g, unknown or other
cagagugcgn

SEQ ID NO: 1200 - RNA, 10 nt, Artificial Sequence
  Description of Artificial Sequence: Synthetic oligonucleotide
  modified_base (8)..(8): a, c, u, g, unknown or other
gagaguangu

SEQ ID NO: 1201 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
gagagugngn

SEQ ID NO: 1202 - RNA, 10 nt, Artificial Sequence
  Description of Artificial Sequence: Synthetic oligonucleotide
  modified_base (10)..(10): a, c, u, g, unknown or other
gagagugagn

SEQ ID NO: 1203 - RNA, 10 nt, Artificial Sequence
  Description of Artificial Sequence: Synthetic oligonucleotide
  modified_base (10)..(10): a, c, u, g, unknown or other
gagagugcgn

SEQ ID NO: 1204 - RNA, 10 nt, Artificial Sequence
  Description of Artificial Sequence: Synthetic oligonucleotide
  modified_base (8)..(8): a, c, u, g, unknown or other
uagaguangu

SEQ ID NO: 1205 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
uagagugngn

SEQ ID NO: 1206 - RNA, 10 nt, Artificial Sequence
  Description of Artificial Sequence: Synthetic oligonucleotide
  modified_base (10)..(10): a, c, u, g, unknown or other
uagagugagn

SEQ ID NO: 1207 - RNA, 10 nt, Artificial Sequence
  Description of Artificial Sequence: Synthetic oligonucleotide
  modified_base (10)..(10): a, c, u, g, unknown or other
uagagugcgn

SEQ ID NO: 1208 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
cngaguangu

SEQ ID NO: 1209 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
  modified_base (10)..(10): a, c, u, g, unknown or other
cngagugngn

SEQ ID NO: 1210 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
cngagugagn

SEQ ID NO: 1211 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
cngagugcgn

SEQ ID NO: 1212 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
ncgaguangu

SEQ ID NO: 1213 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
  modified_base (10)..(10): a, c, u, g, unknown or other
ncgagugngn

SEQ ID NO: 1214 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
ncgagugagn

SEQ ID NO: 1215 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
ncgagugcgn

SEQ ID NO: 1216 - RNA, 10 nt, Artificial Sequence
  Description of Artificial Sequence: Synthetic oligonucleotide
  modified_base (8)..(8): a, c, u, g, unknown or other
acgaguangu

SEQ ID NO: 1217 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
acgagugngn

SEQ ID NO: 1218 - RNA, 10 nt, Artificial Sequence
  Description of Artificial Sequence: Synthetic oligonucleotide
  modified_base (10)..(10): a, c, u, g, unknown or other
acgagugagn

SEQ ID NO: 1219 - RNA, 10 nt, Artificial Sequence
  Description of Artificial Sequence: Synthetic oligonucleotide
  modified_base (10)..(10): a, c, u, g, unknown or other
acgagugcgn

SEQ ID NO: 1220 - RNA, 10 nt, Artificial Sequence
  Description of Artificial Sequence: Synthetic oligonucleotide
  modified_base (8)..(8): a, c, u, g, unknown or other
ccgaguangu

SEQ ID NO: 1221 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
ccgagugngn

SEQ ID NO: 1222 - RNA, 10 nt, Artificial Sequence
  Description of Artificial Sequence: Synthetic oligonucleotide
  modified_base (10)..(10): a, c, u, g, unknown or other
ccgagugagn

SEQ ID NO: 1223 - RNA, 10 nt, Artificial Sequence
  Description of Artificial Sequence: Synthetic oligonucleotide
  modified_base (10)..(10): a, c, u, g, unknown or other
ccgagugcgn

SEQ ID NO: 1224 - RNA, 10 nt, Artificial Sequence
  Description of Artificial Sequence: Synthetic oligonucleotide
  modified_base (8)..(8): a, c, u, g, unknown or other
gcgaguangu

SEQ ID NO: 1225 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
gcgagugngn

SEQ ID NO: 1226 - RNA, 10 nt, Artificial Sequence
  Description of Artificial Sequence: Synthetic oligonucleotide
  modified_base (10)..(10): a, c, u, g, unknown or other
gcgagugagn

SEQ ID NO: 1227 - RNA, 10 nt, Artificial Sequence
  Description of Artificial Sequence: Synthetic oligonucleotide
  modified_base (10)..(10): a, c, u, g, unknown or other
gcgagugcgn

SEQ ID NO: 1228 - RNA, 10 nt, Artificial Sequence
  Description of Artificial Sequence: Synthetic oligonucleotide
  modified_base (8)..(8): a, c, u, g, unknown or other
ucgaguangu

SEQ ID NO: 1229 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
ucgagugngn

SEQ ID NO: 1230 - RNA, 10 nt, Artificial Sequence
  Description of Artificial Sequence: Synthetic oligonucleotide
  modified_base (10)..(10): a, c, u, g, unknown or other
ucgagugagn

SEQ ID NO: 1231 - RNA, 10 nt, Artificial Sequence
  Description of Artificial Sequence: Synthetic oligonucleotide
  modified_base (10)..(10): a, c, u, g, unknown or other
ucgagugcgn

SEQ ID NO: 1232 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
gngaguangu

SEQ ID NO: 1233 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
  modified_base (10)..(10): a, c, u, g, unknown or other
gngagugngn

SEQ ID NO: 1234 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
gngagugagn

SEQ ID NO: 1235 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
gngagugcgn

SEQ ID NO: 1236 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
nggaguangu

SEQ ID NO: 1237 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
  modified_base (10)..(10): a, c, u, g, unknown or other
nggagugngn

SEQ ID NO: 1238 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
nggagugagn

SEQ ID NO: 1239 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
nggagugcgn

SEQ ID NO: 1240 - RNA, 10 nt, Artificial Sequence
  Description of Artificial Sequence: Synthetic oligonucleotide
  modified_base (8)..(8): a, c, u, g, unknown or other
aggaguangu

SEQ ID NO: 1241 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
aggagugngn

SEQ ID NO: 1242 - RNA, 10 nt, Artificial Sequence
  Description of Artificial Sequence: Synthetic oligonucleotide
  modified_base (10)..(10): a, c, u, g, unknown or other
aggagugagn

SEQ ID NO: 1243 - RNA, 10 nt, Artificial Sequence
  Description of Artificial Sequence: Synthetic oligonucleotide
  modified_base (10)..(10): a, c, u, g, unknown or other
aggagugcgn

SEQ ID NO: 1244 - RNA, 10 nt, Artificial Sequence
  Description of Artificial Sequence: Synthetic oligonucleotide
  modified_base (8)..(8): a, c, u, g, unknown or other
cggaguangu

SEQ ID NO: 1245 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
cggagugngn

SEQ ID NO: 1246 - RNA, 10 nt, Artificial Sequence
  Description of Artificial Sequence: Synthetic oligonucleotide
  modified_base (10)..(10): a, c, u, g, unknown or other
cggagugagn

SEQ ID NO: 1247 - RNA, 10 nt, Artificial Sequence
  Description of Artificial Sequence: Synthetic oligonucleotide
  modified_base (10)..(10): a, c, u, g, unknown or other
cggagugcgn

SEQ ID NO: 1248 - RNA, 10 nt, Artificial Sequence
  Description of Artificial Sequence: Synthetic oligonucleotide
  modified_base (8)..(8): a, c, u, g, unknown or other
gggaguangu

SEQ ID NO: 1249 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
gggagugngn

SEQ ID NO: 1250 - RNA, 10 nt, Artificial Sequence
  Description of Artificial Sequence: Synthetic oligonucleotide
  modified_base (10)..(10): a, c, u, g, unknown or other
gggagugagn

SEQ ID NO: 1251 - RNA, 10 nt, Artificial Sequence
  Description of Artificial Sequence: Synthetic oligonucleotide
  modified_base (10)..(10): a, c, u, g, unknown or other
gggagugcgn

SEQ ID NO: 1252 - RNA, 10 nt, Artificial Sequence
  Description of Artificial Sequence: Synthetic oligonucleotide
  modified_base (8)..(8): a, c, u, g, unknown or other
uggaguangu

SEQ ID NO: 1253 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
uggagugngn

SEQ ID NO: 1254 - RNA, 10 nt, Artificial Sequence
  Description of Artificial Sequence: Synthetic oligonucleotide
  modified_base (10)..(10): a, c, u, g, unknown or other
uggagugagn

SEQ ID NO: 1255 - RNA, 10 nt, Artificial Sequence
  Description of Artificial Sequence: Synthetic oligonucleotide
  modified_base (10)..(10): a, c, u, g, unknown or other
uggagugcgn

SEQ ID NO: 1256 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
ungaguangu

SEQ ID NO: 1257 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
  modified_base (10)..(10): a, c, u, g, unknown or other
ungagugngn

SEQ ID NO: 1258 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
ungagugagn

SEQ ID NO: 1259 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
ungagugcgn

SEQ ID NO: 1260 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
nugaguangu

SEQ ID NO: 1261 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
  modified_base (10)..(10): a, c, u, g, unknown or other
nugagugngn

SEQ ID NO: 1262 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
nugagugagn

SEQ ID NO: 1263 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
nugagugcgn

SEQ ID NO: 1264 - RNA, 10 nt, Artificial Sequence
  Description of Artificial Sequence: Synthetic oligonucleotide
  modified_base (8)..(8): a, c, u, g, unknown or other
augaguangu

SEQ ID NO: 1265 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
augagugngn

SEQ ID NO: 1266 - RNA, 10 nt, Artificial Sequence
  Description of Artificial Sequence: Synthetic oligonucleotide
  modified_base (10)..(10): a, c, u, g, unknown or other
augagugagn

SEQ ID NO: 1267 - RNA, 10 nt, Artificial Sequence
  Description of Artificial Sequence: Synthetic oligonucleotide
  modified_base (10)..(10): a, c, u, g, unknown or other
augagugcgn

SEQ ID NO: 1268 - RNA, 10 nt, Artificial Sequence
  Description of Artificial Sequence: Synthetic oligonucleotide
  modified_base (8)..(8): a, c, u, g, unknown or other
cugaguangu

SEQ ID NO: 1269 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
cugagugngn

SEQ ID NO: 1270 - RNA, 10 nt, Artificial Sequence
  Description of Artificial Sequence: Synthetic oligonucleotide
  modified_base (10)..(10): a, c, u, g, unknown or other
cugagugagn

SEQ ID NO: 1271 - RNA, 10 nt, Artificial Sequence
  Description of Artificial Sequence: Synthetic oligonucleotide
  modified_base (10)..(10): a, c, u, g, unknown or other
cugagugcgn

SEQ ID NO: 1272 - RNA, 10 nt, Artificial Sequence
  Description of Artificial Sequence: Synthetic oligonucleotide
  modified_base (8)..(8): a, c, u, g, unknown or other
gugaguangu

SEQ ID NO: 1273 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
gugagugngn

SEQ ID NO: 1274 - RNA, 10 nt, Artificial Sequence
  Description of Artificial Sequence: Synthetic oligonucleotide
  modified_base (10)..(10): a, c, u, g, unknown or other
gugagugagn

SEQ ID NO: 1275 - RNA, 10 nt, Artificial Sequence
  Description of Artificial Sequence: Synthetic oligonucleotide
  modified_base (10)..(10): a, c, u, g, unknown or other
gugagugcgn

SEQ ID NO: 1276 - RNA, 10 nt, Artificial Sequence
  Description of Artificial Sequence: Synthetic oligonucleotide
  modified_base (8)..(8): a, c, u, g, unknown or other
uugaguangu

SEQ ID NO: 1277 - RNA, 10 nt, Artificial Sequence
  Description of Artificial Sequence: Synthetic oligonucleotide
  modified_base (8)..(8): a, c, u, g, unknown or other
  modified_base (10)..(10): a, c, u, g, unknown or other
uugagugngn

SEQ ID NO: 1278 - RNA, 10 nt, Artificial Sequence
  Description of Artificial Sequence: Synthetic oligonucleotide
  modified_base (10)..(10): a, c, u, g, unknown or other
uugagugagn

SEQ ID NO: 1279 - RNA, 10 nt, Artificial Sequence
  Description of Artificial Sequence: Synthetic oligonucleotide
  modified_base (10)..(10): a, c, u, g, unknown or other
uugagugcgn

SEQ ID NO: 1280 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
angagugggn

SEQ ID NO: 1281 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
angagugugn

SEQ ID NO: 1282 - RNA, 10 nt, Artificial Sequence
  Description of Artificial Sequence: Synthetic oligonucleotide
  modified_base (2)..(2): a, c, u, g, unknown or other
angagugaga

SEQ ID NO: 1283 - RNA, 10 nt, Artificial Sequence
  Description of Artificial Sequence: Synthetic oligonucleotide
  modified_base (2)..(2): a, c, u, g, unknown or other
angagugcga

SEQ ID NO: 1284 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
nagagugggn

SEQ ID NO: 1285 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
nagagugugn

SEQ ID NO: 1286 - RNA, 10 nt, Artificial Sequence
  Description of Artificial Sequence: Synthetic oligonucleotide
  modified_base (1)..(1): a, c, u, g, unknown or other
nagagugaga

SEQ ID NO: 1287 - RNA, 10 nt, Artificial Sequence
  Description of Artificial Sequence: Synthetic oligonucleotide
  modified_base (1)..(1): a, c, u, g, unknown or other
nagagugcga

SEQ ID NO: 1288 - RNA, 10 nt, Artificial Sequence
  Description of Artificial Sequence: Synthetic oligonucleotide
  modified_base (10)..(10): a, c, u, g, unknown or other
aagagugggn

SEQ ID NO: 1289 - RNA, 10 nt, Artificial Sequence
  Description of Artificial Sequence: Synthetic oligonucleotide
  modified_base (10)..(10): a, c, u, g, unknown or other
aagagugugn

SEQ ID NO: 1290 - RNA, 10 nt, Artificial Sequence
  Description of Artificial Sequence: Synthetic oligonucleotide
aagagugaga

SEQ ID NO: 1291 - RNA, 10 nt, Artificial Sequence
  Description of Artificial Sequence: Synthetic oligonucleotide
aagagugcga

SEQ ID NO: 1292 - RNA, 10 nt, Artificial Sequence
  Description of Artificial Sequence: Synthetic oligonucleotide
  modified_base (10)..(10): a, c, u, g, unknown or other
cagagugggn

SEQ ID NO: 1293 - RNA, 10 nt, Artificial Sequence
  Description of Artificial Sequence: Synthetic oligonucleotide
  modified_base (10)..(10): a, c, u, g, unknown or other
cagagugugn

SEQ ID NO: 1294 - RNA, 10 nt, Artificial Sequence
  Description of Artificial Sequence: Synthetic oligonucleotide
cagagugaga

SEQ ID NO: 1295 - RNA, 10 nt, Artificial Sequence
  Description of Artificial Sequence: Synthetic oligonucleotide
cagagugcga

SEQ ID NO: 1296 - RNA, 10 nt, Artificial Sequence
  Description of Artificial Sequence: Synthetic oligonucleotide
  modified_base (10)..(10): a, c, u, g, unknown or other
gagagugggn

SEQ ID NO: 1297 - RNA, 10 nt, Artificial Sequence
  Description of Artificial Sequence: Synthetic oligonucleotide
  modified_base (10)..(10): a, c, u, g, unknown or other
gagagugugn

SEQ ID NO: 1298 - RNA, 10 nt, Artificial Sequence
  Description of Artificial Sequence: Synthetic oligonucleotide
gagagugaga

SEQ ID NO: 1299 - RNA, 10 nt, Artificial Sequence
  Description of Artificial Sequence: Synthetic oligonucleotide
gagagugcga

SEQ ID NO: 1300 - RNA, 10 nt, Artificial Sequence
  Description of Artificial Sequence: Synthetic oligonucleotide
  modified_base (10)..(10): a, c, u, g, unknown or other
uagagugggn

SEQ ID NO: 1301 - RNA, 10 nt, Artificial Sequence
  Description of Artificial Sequence: Synthetic oligonucleotide
  modified_base (10)..(10): a, c, u, g, unknown or other
uagagugugn

SEQ ID NO: 1302 - RNA, 10 nt, Artificial Sequence
  Description of Artificial Sequence: Synthetic oligonucleotide
uagagugaga

SEQ ID NO: 1303 - RNA, 10 nt, Artificial Sequence
  Description of Artificial Sequence: Synthetic oligonucleotide
uagagugcga

SEQ ID NO: 1304 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
cngagugggn

SEQ ID NO: 1305 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
cngagugugn

SEQ ID NO: 1306 - RNA, 10 nt, Artificial Sequence
  Description of Artificial Sequence: Synthetic oligonucleotide
  modified_base (2)..(2): a, c, u, g, unknown or other
cngagugaga

SEQ ID NO: 1307 - RNA, 10 nt, Artificial Sequence
  Description of Artificial Sequence: Synthetic oligonucleotide
  modified_base (2)..(2): a, c, u, g, unknown or other
cngagugcga

SEQ ID NO: 1308 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
ncgagugggn

SEQ ID NO: 1309 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
ncgagugugn

SEQ ID NO: 1310 - RNA, 10 nt, Artificial Sequence
  Description of Artificial Sequence: Synthetic oligonucleotide
  modified_base (1)..(1): a, c, u, g, unknown or other
ncgagugaga

SEQ ID NO: 1311 - RNA, 10 nt, Artificial Sequence
  Description of Artificial Sequence: Synthetic oligonucleotide
  modified_base (1)..(1): a, c, u, g, unknown or other
ncgagugcga

SEQ ID NO: 1312 - RNA, 10 nt, Artificial Sequence
  Description of Artificial Sequence: Synthetic oligonucleotide
  modified_base (10)..(10): a, c, u, g, unknown or other
acgagugggn

SEQ ID NO: 1313 - RNA, 10 nt, Artificial Sequence
  Description of Artificial Sequence: Synthetic oligonucleotide
  modified_base (10)..(10): a, c, u, g, unknown or other
acgagugugn

SEQ ID NO: 1314 - RNA, 10 nt, Artificial Sequence
  Description of Artificial Sequence: Synthetic oligonucleotide
acgagugaga

SEQ ID NO: 1315 - RNA, 10 nt, Artificial Sequence
  Description of Artificial Sequence: Synthetic oligonucleotide
acgagugcga

SEQ ID NO: 1316 - RNA, 10 nt, Artificial Sequence
  Description of Artificial Sequence: Synthetic oligonucleotide
  modified_base (10)..(10): a, c, u, g, unknown or other
ccgagugggn

SEQ ID NO: 1317 - RNA, 10 nt, Artificial Sequence
  Description of Artificial Sequence: Synthetic oligonucleotide
  modified_base (10)..(10): a, c, u, g, unknown or other
ccgagugugn

SEQ ID NO: 1318 - RNA, 10 nt, Artificial Sequence
  Description of Artificial Sequence: Synthetic oligonucleotide
ccgagugaga

SEQ ID NO: 1319 - RNA, 10 nt, Artificial Sequence
  Description of Artificial Sequence: Synthetic oligonucleotide
ccgagugcga

SEQ ID NO: 1320 - RNA, 10 nt, Artificial Sequence
  Description of Artificial Sequence: Synthetic oligonucleotide
  modified_base (10)..(10): a, c, u, g, unknown or other
gcgagugggn

SEQ ID NO: 1321 - RNA, 10 nt, Artificial Sequence
  Description of Artificial Sequence: Synthetic oligonucleotide
  modified_base (10)..(10): a, c, u, g, unknown or other
gcgagugugn

SEQ ID NO: 1322 - RNA, 10 nt, Artificial Sequence
  Description of Artificial Sequence: Synthetic oligonucleotide
gcgagugaga

SEQ ID NO: 1323 - RNA, 10 nt, Artificial Sequence
  Description of Artificial Sequence: Synthetic oligonucleotide
gcgagugcga

SEQ ID NO: 1324 - RNA, 10 nt, Artificial Sequence
  Description of Artificial Sequence: Synthetic oligonucleotide
  modified_base (10)..(10): a, c, u, g, unknown or other
ucgagugggn

SEQ ID NO: 1325 - RNA, 10 nt, Artificial Sequence
  Description of Artificial Sequence: Synthetic oligonucleotide
  modified_base (10)..(10): a, c, u, g, unknown or other
ucgagugugn

SEQ ID NO: 1326 - RNA, 10 nt, Artificial Sequence
  Description of Artificial Sequence: Synthetic oligonucleotide
ucgagugaga

SEQ ID NO: 1327 - RNA, 10 nt, Artificial Sequence
  Description of Artificial Sequence: Synthetic oligonucleotide
ucgagugcga

SEQ ID NO: 1328 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
gngagugggn

SEQ ID NO: 1329 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
gngagugugn

SEQ ID NO: 1330 - RNA, 10 nt, Artificial Sequence
  Description of Artificial Sequence: Synthetic oligonucleotide
  modified_base (2)..(2): a, c, u, g, unknown or other
gngagugaga

SEQ ID NO: 1331 - RNA, 10 nt, Artificial Sequence
  Description of Artificial Sequence: Synthetic oligonucleotide
  modified_base (2)..(2): a, c, u, g, unknown or other
gngagugcga

SEQ ID NO: 1332 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
nggagugggn

SEQ ID NO: 1333 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
nggagugugn

SEQ ID NO: 1334 - RNA, 10 nt, Artificial Sequence
  Description of Artificial Sequence: Synthetic oligonucleotide
  modified_base (1)..(1): a, c, u, g, unknown or other
nggagugaga

SEQ ID NO: 1335 - RNA, 10 nt, Artificial Sequence
  Description of Artificial Sequence: Synthetic oligonucleotide
  modified_base (1)..(1): a, c, u, g, unknown or other
nggagugcga

SEQ ID NO: 1336 - RNA, 10 nt, Artificial Sequence
  Description of Artificial Sequence: Synthetic oligonucleotide
  modified_base (10)..(10): a, c, u, g, unknown or other
aggagugggn

SEQ ID NO: 1337 - RNA, 10 nt, Artificial Sequence
  Description of Artificial Sequence: Synthetic oligonucleotide
  modified_base (10)..(10): a, c, u, g, unknown or other
aggagugugn

SEQ ID NO: 1338 - RNA, 10 nt, Artificial Sequence
  Description of Artificial Sequence: Synthetic oligonucleotide
aggagugaga

SEQ ID NO: 1339 - RNA, 10 nt, Artificial Sequence
  Description of Artificial Sequence: Synthetic oligonucleotide
aggagugcga

SEQ ID NO: 1340 - RNA, 10 nt, Artificial Sequence
  Description of Artificial Sequence: Synthetic oligonucleotide
  modified_base (10)..(10): a, c, u, g, unknown or other
cggagugggn

SEQ ID NO: 1341 - RNA, 10 nt, Artificial Sequence
  Description of Artificial Sequence: Synthetic oligonucleotide
  modified_base (10)..(10): a, c, u, g, unknown or other
cggagugugn

SEQ ID NO: 1342 - RNA, 10 nt, Artificial Sequence
  Description of Artificial Sequence: Synthetic oligonucleotide
cggagugaga

SEQ ID NO: 1343 - RNA, 10 nt, Artificial Sequence
  Description of Artificial Sequence: Synthetic oligonucleotide
cggagugcga

SEQ ID NO: 1344 - RNA, 10 nt, Artificial Sequence
  Description of Artificial Sequence: Synthetic oligonucleotide
  modified_base (10)..(10): a, c, u, g, unknown or other
gggagugggn

SEQ ID NO: 1345 - RNA, 10 nt, Artificial Sequence
  Description of Artificial Sequence: Synthetic oligonucleotide
  modified_base (10)..(10): a, c, u, g, unknown or other
gggagugugn

SEQ ID NO: 1346 - RNA, 10 nt, Artificial Sequence
  Description of Artificial Sequence: Synthetic oligonucleotide
gggagugaga

SEQ ID NO: 1347 - RNA, 10 nt, Artificial Sequence
  Description of Artificial Sequence: Synthetic oligonucleotide
gggagugcga

SEQ ID NO: 1348 - RNA, 10 nt, Artificial Sequence
  Description of Artificial Sequence: Synthetic oligonucleotide
  modified_base (10)..(10): a, c, u, g, unknown or other
uggagugggn

SEQ ID NO: 1349 - RNA, 10 nt, Artificial Sequence
  Description of Artificial Sequence: Synthetic oligonucleotide
  modified_base (10)..(10): a, c, u, g, unknown or other
uggagugugn

SEQ ID NO: 1350 - RNA, 10 nt, Artificial Sequence
  Description of Artificial Sequence: Synthetic oligonucleotide
uggagugaga

SEQ ID NO: 1351 - RNA, 10 nt, Artificial Sequence
  Description of Artificial Sequence: Synthetic oligonucleotide
uggagugcga

SEQ ID NO: 1352 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
ungagugggn

SEQ ID NO: 1353 - RNA, 10 nt, Artificial Sequence
  Description of Artificial Sequence: Synthetic oligonucleotide
  modified_base (2)..(2): a, c, u, g, unknown or other
  modified_base (10)..(10): a, c, u, g, unknown or other
ungagugugn

SEQ ID NO: 1354 - RNA, 10 nt, Artificial Sequence
  Description of Artificial Sequence: Synthetic oligonucleotide
  modified_base (2)..(2): a, c, u, g, unknown or other
ungagugaga

SEQ ID NO: 1355 - RNA, 10 nt, Artificial Sequence
  Description of Artificial Sequence: Synthetic oligonucleotide
  modified_base (2)..(2): a, c, u, g, unknown or other
ungagugcga

SEQ ID NO: 1356 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
nugagugggn

SEQ ID NO: 1357 - RNA, 10 nt, Artificial Sequence
  Description of Artificial Sequence: Synthetic oligonucleotide
  modified_base (1)..(1): a, c, u, g, unknown or other
  modified_base (10)..(10): a, c, u, g, unknown or other
nugagugugn

SEQ ID NO: 1358 - RNA, 10 nt, Artificial Sequence
  Description of Artificial Sequence: Synthetic oligonucleotide
  modified_base (1)..(1): a, c, u, g, unknown or other
nugagugaga

SEQ ID NO: 1359 - RNA, 10 nt, Artificial Sequence
  Description of Artificial Sequence: Synthetic oligonucleotide
  modified_base (1)..(1): a, c, u, g, unknown or other
nugagugcga

SEQ ID NO: 1360 - RNA, 10 nt, Artificial Sequence
  Description of Artificial Sequence: Synthetic oligonucleotide
  modified_base (10)..(10): a, c, u, g, unknown or other
augagugggn

SEQ ID NO: 1361 - RNA, 10 nt, Artificial Sequence
  Description of Artificial Sequence: Synthetic oligonucleotide
  modified_base (10)..(10): a, c, u, g, unknown or other
augagugugn

SEQ ID NO: 1362 - RNA, 10 nt, Artificial Sequence
  Description of Artificial Sequence: Synthetic oligonucleotide
augagugaga

SEQ ID NO: 1363 - RNA, 10 nt, Artificial Sequence
  Description of Artificial Sequence: Synthetic oligonucleotide
augagugcga

SEQ ID NO: 1364 - RNA, 10 nt, Artificial Sequence
  Description of Artificial Sequence: Synthetic oligonucleotide
  modified_base (10)..(10): a, c, u, g, unknown or other
cugagugggn

SEQ ID NO: 1365 - RNA, 10 nt, Artificial Sequence
  Description of Artificial Sequence: Synthetic oligonucleotide
  modified_base (10)..(10): a, c, u, g, unknown or other
cugagugugn

SEQ ID NO: 1366 - RNA, 10 nt, Artificial Sequence
  Description of Artificial Sequence: Synthetic oligonucleotide
cugagugaga

SEQ ID NO: 1367 - RNA, 10 nt, Artificial Sequence
  Description of Artificial Sequence: Synthetic oligonucleotide
cugagugcga

SEQ ID NO: 1368 - RNA, 10 nt, Artificial Sequence
  Description of Artificial Sequence: Synthetic oligonucleotide
  modified_base (10)..(10): a, c, u, g, unknown or other
gugagugggn

SEQ ID NO: 1369 - RNA, 10 nt, Artificial Sequence
  Description of Artificial Sequence: Synthetic oligonucleotide
  modified_base (10)..(10): a, c, u, g, unknown or other
gugagugugn

SEQ ID NO: 1370 - RNA, 10 nt, Artificial Sequence
  Description of Artificial Sequence: Synthetic oligonucleotide
gugagugaga

SEQ ID NO: 1371 - RNA, 10 nt, Artificial Sequence
  Description of Artificial Sequence: Synthetic oligonucleotide
gugagugcga

SEQ ID NO: 1372 - RNA, 10 nt, Artificial Sequence
  Description of Artificial Sequence: Synthetic oligonucleotide
  modified_base (10)..(10): a, c, u, g, unknown or other
uugagugggn

SEQ ID NO: 1373 - RNA, 10 nt, Artificial Sequence
  Description of Artificial Sequence: Synthetic oligonucleotide
  modified_base (10)..(10): a, c, u, g, unknown or other
uugagugugn

SEQ ID NO: 1374 - RNA, 10 nt, Artificial Sequence
  Description of Artificial Sequence: Synthetic oligonucleotide
uugagugaga

SEQ ID NO: 1375 - RNA, 10 nt, Artificial Sequence
  Description of Artificial Sequence: Synthetic oligonucleotide
uugagugcga

SEQ ID NO: 1376 - RNA, 10 nt, Artificial Sequence
  Description of Artificial Sequence: Synthetic oligonucleotide
  modified_base (2)..(2): a, c, u, g, unknown or other
angaguggga

SEQ ID NO: 1377 - RNA, 10 nt, Artificial Sequence
  Description of Artificial Sequence: Synthetic oligonucleotide
  modified_base (2)..(2): a, c, u, g, unknown or other
angaguguga

SEQ ID NO: 1378 - RNA, 10 nt, Artificial Sequence
  Description of Artificial Sequence: Synthetic oligonucleotide
  modified_base (2)..(2): a, c, u, g, unknown or other
angagugagc

SEQ ID NO: 1379 - RNA, 10 nt, Artificial Sequence
  Description of Artificial Sequence: Synthetic oligonucleotide
  modified_base (2)..(2): a, c, u, g, unknown or other
angagugcgc

SEQ ID NO: 1380 - RNA, 10 nt, Artificial Sequence
  Description of Artificial Sequence: Synthetic oligonucleotide
  modified_base (1)..(1): a, c, u, g, unknown or other
nagaguggga

SEQ ID NO: 1381 - RNA, 10 nt, Artificial Sequence
  Description of Artificial Sequence: Synthetic oligonucleotide
  modified_base (1)..(1): a, c, u, g, unknown or other
nagaguguga

SEQ ID NO: 1382 - RNA, 10 nt, Artificial Sequence
  Description of Artificial Sequence: Synthetic oligonucleotide
  modified_base (1)..(1): a, c, u, g, unknown or other
nagagugagc

SEQ ID NO: 1383 - RNA, 10 nt, Artificial Sequence
  Description of Artificial Sequence: Synthetic oligonucleotide
  modified_base (1)..(1): a, c, u, g, unknown or other
nagagugcgc

SEQ ID NO: 1384 - RNA, 10 nt, Artificial Sequence
  Description of Artificial Sequence: Synthetic oligonucleotide
aagaguggga

SEQ ID NO: 1385 - RNA, 10 nt, Artificial Sequence
  Description of Artificial Sequence: Synthetic oligonucleotide
aagaguguga

SEQ ID NO: 1386 - RNA, 10 nt, Artificial Sequence
  Description of Artificial Sequence: Synthetic oligonucleotide
aagagugagc

SEQ ID NO: 1387 - RNA, 10 nt, Artificial Sequence
  Description of Artificial Sequence: Synthetic oligonucleotide
aagagugcgc

SEQ ID NO: 1388 - RNA, 10 nt, Artificial Sequence
  Description of Artificial Sequence: Synthetic oligonucleotide
cagaguggga

SEQ ID NO: 1389 - RNA, 10 nt, Artificial Sequence
  Description of Artificial Sequence: Synthetic oligonucleotide
cagaguguga

SEQ ID NO: 1390 - RNA, 10 nt, Artificial Sequence
  Description of Artificial Sequence: Synthetic oligonucleotide
cagagugagc

SEQ ID NO: 1391 - RNA, 10 nt, Artificial Sequence
  Description of Artificial Sequence: Synthetic oligonucleotide
cagagugcgc

SEQ ID NO: 1392 - RNA, 10 nt, Artificial Sequence
  Description of Artificial Sequence: Synthetic oligonucleotide
gagaguggga

SEQ ID NO: 1393 - RNA, 10 nt, Artificial Sequence
  Description of Artificial Sequence: Synthetic oligonucleotide
gagaguguga

SEQ ID NO: 1394 - RNA, 10 nt, Artificial Sequence
  Description of Artificial Sequence: Synthetic oligonucleotide
gagagugagc

SEQ ID NO: 1395 - RNA, 10 nt, Artificial Sequence
  Description of Artificial Sequence: Synthetic oligonucleotide
gagagugcgc

SEQ ID NO: 1396 - RNA, 10 nt, Artificial Sequence
  Description of Artificial Sequence: Synthetic oligonucleotide
uagaguggga

SEQ ID NO: 1397 - RNA, 10 nt, Artificial Sequence
  Description of Artificial Sequence: Synthetic oligonucleotide
uagaguguga

SEQ ID NO: 1398 - RNA, 10 nt, Artificial Sequence
  Description of Artificial Sequence: Synthetic oligonucleotide
uagagugagc

SEQ ID NO: 1399 - RNA, 10 nt, Artificial Sequence
  Description of Artificial Sequence: Synthetic oligonucleotide
uagagugcgc

SEQ ID NO: 1400 - RNA, 10 nt, Artificial Sequence
  Description of Artificial Sequence: Synthetic oligonucleotide
  modified_base (2)..(2): a, c, u, g, unknown or other
cngaguggga

SEQ ID NO: 1401 - RNA, 10 nt, Artificial Sequence
  Description of Artificial Sequence: Synthetic oligonucleotide
  modified_base (2)..(2): a, c, u, g, unknown or other
cngaguguga

SEQ ID NO: 1402 - RNA, 10 nt, Artificial Sequence
  Description of Artificial Sequence: Synthetic oligonucleotide
  modified_base (2)..(2): a, c, u, g, unknown or other
cngagugagc

SEQ ID NO: 1403 - RNA, 10 nt, Artificial Sequence
  Description of Artificial Sequence: Synthetic oligonucleotide
  modified_base (2)..(2): a, c, u, g, unknown or other
cngagugcgc

SEQ ID NO: 1404 - RNA, 10 nt, Artificial Sequence
  Description of Artificial Sequence: Synthetic oligonucleotide
  modified_base (1)..(1): a, c, u, g, unknown or other
ncgaguggga

SEQ ID NO: 1405 - RNA, 10 nt, Artificial Sequence
  Description of Artificial Sequence: Synthetic oligonucleotide
  modified_base (1)..(1): a, c, u, g, unknown or other
ncgaguguga

SEQ ID NO: 1406 - RNA, 10 nt, Artificial Sequence
  Description of Artificial Sequence: Synthetic oligonucleotide
  modified_base (1)..(1): a, c, u, g, unknown or other
ncgagugagc

SEQ ID NO: 1407 - RNA, 10 nt, Artificial Sequence
  Description of Artificial Sequence: Synthetic oligonucleotide
  modified_base (1)..(1): a, c, u, g, unknown or other
ncgagugcgc

SEQ ID NO: 1408 - RNA, 10 nt, Artificial Sequence
  Description of Artificial Sequence: Synthetic oligonucleotide
acgaguggga

SEQ ID NO: 1409 - RNA, 10 nt, Artificial Sequence
  Description of Artificial Sequence: Synthetic oligonucleotide
acgaguguga

SEQ ID NO: 1410 - RNA, 10 nt, Artificial Sequence
  Description of Artificial Sequence: Synthetic oligonucleotide
acgagugagc

SEQ ID NO: 1411 - RNA, 10 nt, Artificial Sequence
  Description of Artificial Sequence: Synthetic oligonucleotide
acgagugcgc

SEQ ID NO: 1412 - RNA, 10 nt, Artificial Sequence
  Description of Artificial Sequence: Synthetic oligonucleotide
ccgaguggga

SEQ ID NO: 1413 - RNA, 10 nt, Artificial Sequence
  Description of Artificial Sequence: Synthetic oligonucleotide
ccgaguguga

SEQ ID NO: 1414 - RNA, 10 nt, Artificial Sequence
  Description of Artificial Sequence: Synthetic oligonucleotide
ccgagugagc

SEQ ID NO: 1415 - RNA, 10 nt, Artificial Sequence
  Description of Artificial Sequence: Synthetic oligonucleotide
ccgagugcgc

SEQ ID NO: 1416 - RNA, 10 nt, Artificial Sequence
  Description of Artificial Sequence: Synthetic oligonucleotide
gcgaguggga

SEQ ID NO: 1417 - RNA, 10 nt, Artificial Sequence
  Description of Artificial Sequence: Synthetic oligonucleotide
gcgaguguga

SEQ ID NO: 1418 - RNA, 10 nt, Artificial Sequence
  Description of Artificial Sequence: Synthetic oligonucleotide
gcgagugagc

SEQ ID NO: 1419 - RNA, 10 nt, Artificial Sequence
  Description of Artificial Sequence: Synthetic oligonucleotide
gcgagugcgc

SEQ ID NO: 1420 - RNA, 10 nt, Artificial Sequence
  Description of Artificial Sequence: Synthetic oligonucleotide
ucgaguggga

SEQ ID NO: 1421 - RNA, 10 nt, Artificial Sequence
  Description of Artificial Sequence: Synthetic oligonucleotide
ucgaguguga

SEQ ID NO: 1422 - RNA, 10 nt, Artificial Sequence
  Description of Artificial Sequence: Synthetic oligonucleotide
ucgagugagc

SEQ ID NO: 1423 - RNA, 10 nt, Artificial Sequence
  Description of Artificial Sequence: Synthetic oligonucleotide
ucgagugcgc

SEQ ID NO: 1424 - RNA, 10 nt, Artificial Sequence
  Description of Artificial Sequence: Synthetic oligonucleotide
  modified_base (2)..(2): a, c, u, g, unknown or other
gngaguggga

SEQ ID NO: 1425 - RNA, 10 nt, Artificial Sequence
  Description of Artificial Sequence: Synthetic oligonucleotide
  modified_base (2)..(2): a, c, u, g, unknown or other
gngaguguga

SEQ ID NO: 1426 - RNA, 10 nt, Artificial Sequence
  Description of Artificial Sequence: Synthetic oligonucleotide
  modified_base (2)..(2): a, c, u, g, unknown or other
gngagugagc

SEQ ID NO: 1427 - RNA, 10 nt, Artificial Sequence
  Description of Artificial Sequence: Synthetic oligonucleotide
  modified_base (2)..(2): a, c, u, g, unknown or other
gngagugcgc

SEQ ID NO: 1428 - RNA, 10 nt, Artificial Sequence
  Description of Artificial Sequence: Synthetic oligonucleotide
  modified_base (1)..(1): a, c, u, g, unknown or other
nggaguggga

SEQ ID NO: 1429 - RNA, 10 nt, Artificial Sequence
  Description of Artificial Sequence: Synthetic oligonucleotide
  modified_base (1)..(1): a, c, u, g, unknown or other
nggaguguga

SEQ ID NO: 1430 - RNA, 10 nt, Artificial Sequence
  Description of Artificial Sequence: Synthetic oligonucleotide
  modified_base (1)..(1): a, c, u, g, unknown or other
nggagugagc

SEQ ID NO: 1431 - RNA, 10 nt, Artificial Sequence
  Description of Artificial Sequence: Synthetic oligonucleotide
  modified_base (1)..(1): a, c, u, g, unknown or other
nggagugcgc

SEQ ID NO: 1432 - RNA, 10 nt, Artificial Sequence
  Description of Artificial Sequence: Synthetic oligonucleotide
aggaguggga

SEQ ID NO: 1433 - RNA, 10 nt, Artificial Sequence
  Description of Artificial Sequence: Synthetic oligonucleotide
aggaguguga

SEQ ID NO: 1434 - RNA, 10 nt, Artificial Sequence
  Description of Artificial Sequence: Synthetic oligonucleotide
aggagugagc

SEQ ID NO: 1435 - RNA, 10 nt, Artificial Sequence
  Description of Artificial Sequence: Synthetic oligonucleotide
aggagugcgc

SEQ ID NO: 1436 - RNA, 10 nt, Artificial Sequence
  Description of Artificial Sequence: Synthetic oligonucleotide
cggaguggga

SEQ ID NO: 1437 - RNA, 10 nt, Artificial Sequence
  Description of Artificial Sequence: Synthetic oligonucleotide
cggaguguga

SEQ ID NO: 1438 - RNA, 10 nt, Artificial Sequence
  Description of Artificial Sequence: Synthetic oligonucleotide
cggagugagc

SEQ ID NO: 1439 - RNA, 10 nt, Artificial Sequence
  Description of Artificial Sequence: Synthetic oligonucleotide
cggagugcgc

SEQ ID NO: 1440 - RNA, 10 nt, Artificial Sequence
  Description of Artificial Sequence: Synthetic oligonucleotide
gggaguggga

SEQ ID NO: 1441 - RNA, 10 nt, Artificial Sequence
  Description of Artificial Sequence: Synthetic oligonucleotide
gggaguguga

SEQ ID NO: 1442 - RNA, 10 nt, Artificial Sequence
  Description of Artificial Sequence: Synthetic oligonucleotide
gggagugagc

SEQ ID NO: 1443 - RNA, 10 nt, Artificial Sequence
  Description of Artificial Sequence: Synthetic oligonucleotide
gggagugcgc

SEQ ID NO: 1444 - RNA, 10 nt, Artificial Sequence
  Description of Artificial Sequence: Synthetic oligonucleotide
uggaguggga

SEQ ID NO: 1445 - RNA, 10 nt, Artificial Sequence
  Description of Artificial Sequence: Synthetic oligonucleotide
uggaguguga

SEQ ID NO: 1446 - RNA, 10 nt, Artificial Sequence
  Description of Artificial Sequence: Synthetic oligonucleotide
uggagugagc

SEQ ID NO: 1447 - RNA, 10 nt, Artificial Sequence
  Description of Artificial Sequence: Synthetic oligonucleotide
uggagugcgc

SEQ ID NO: 1448 - RNA, 10 nt, Artificial Sequence
  Description of Artificial Sequence: Synthetic oligonucleotide
  modified_base (2)..(2): a, c, u, g, unknown or other
ungaguggga

SEQ ID NO: 1449 - RNA, 10 nt, Artificial Sequence
  Description of Artificial Sequence: Synthetic oligonucleotide
  modified_base (2)..(2): a, c, u, g, unknown or other
ungaguguga

SEQ ID NO: 1450 - RNA, 10 nt, Artificial Sequence
  Description of Artificial Sequence: Synthetic oligonucleotide
  modified_base (2)..(2): a, c, u, g, unknown or other
ungagugagc

SEQ ID NO: 1451 - RNA, 10 nt, Artificial Sequence
  Description of Artificial Sequence: Synthetic oligonucleotide
  modified_base (2)..(2): a, c, u, g, unknown or other
ungagugcgc

SEQ ID NO: 1452 - RNA, 10 nt, Artificial Sequence
  Description of Artificial Sequence: Synthetic oligonucleotide
  modified_base (1)..(1): a, c, u, g, unknown or other
nugaguggga

SEQ ID NO: 1453 - RNA, 10 nt, Artificial Sequence
  Description of Artificial Sequence: Synthetic oligonucleotide
  modified_base (1)..(1): a, c, u, g, unknown or other
nugaguguga

SEQ ID NO: 1454 - RNA, 10 nt, Artificial Sequence
  Description of Artificial Sequence: Synthetic oligonucleotide
  modified_base (1)..(1): a, c, u, g, unknown or other
nugagugagc

SEQ ID NO: 1455 - RNA, 10 nt, Artificial Sequence
  Description of Artificial Sequence: Synthetic oligonucleotide
  modified_base (1)..(1): a, c, u, g, unknown or other
nugagugcgc

SEQ ID NO: 1456 - RNA, 10 nt, Artificial Sequence
  Description of Artificial Sequence: Synthetic oligonucleotide
augaguggga

SEQ ID NO: 1457 - RNA, 10 nt, Artificial Sequence
  Description of Artificial Sequence: Synthetic oligonucleotide
augaguguga

SEQ ID NO: 1458 - RNA, 10 nt, Artificial Sequence
  Description of Artificial Sequence: Synthetic oligonucleotide
augagugagc

SEQ ID NO: 1459 - RNA, 10 nt, Artificial Sequence
  Description of Artificial Sequence: Synthetic oligonucleotide
augagugcgc

SEQ ID NO: 1460 - RNA, 10 nt, Artificial Sequence
  Description of Artificial Sequence: Synthetic oligonucleotide
cugaguggga

SEQ ID NO: 1461 - RNA, 10 nt, Artificial Sequence
  Description of Artificial Sequence: Synthetic oligonucleotide
cugaguguga

SEQ ID NO: 1462 - RNA, 10 nt, Artificial Sequence
  Description of Artificial Sequence: Synthetic oligonucleotide
cugagugagc

SEQ ID NO: 1463 - RNA, 10 nt, Artificial Sequence
  Description of Artificial Sequence: Synthetic oligonucleotide
cugagugcgc

SEQ ID NO: 1464 - RNA, 10 nt, Artificial Sequence
  Description of Artificial Sequence: Synthetic oligonucleotide
gugaguggga

SEQ ID NO: 1465 - RNA, 10 nt, Artificial Sequence
  Description of Artificial Sequence: Synthetic oligonucleotide
gugaguguga

SEQ ID NO: 1466 - RNA, 10 nt, Artificial Sequence
  Description of Artificial Sequence: Synthetic oligonucleotide
gugagugagc

SEQ ID NO: 1467 - RNA, 10 nt, Artificial Sequence
  Description of Artificial Sequence: Synthetic oligonucleotide
gugagugcgc

SEQ ID NO: 1468 - RNA, 10 nt, Artificial Sequence
  Description of Artificial Sequence: Synthetic oligonucleotide
uugaguggga

SEQ ID NO: 1469 - RNA, 10 nt, Artificial Sequence
  Description of Artificial Sequence: Synthetic oligonucleotide
uugaguguga

SEQ ID NO: 1470 - RNA, 10 nt, Artificial Sequence
  Description of Artificial Sequence: Synthetic oligonucleotide
uugagugagc

SEQ ID NO: 1471 - RNA, 10 nt, Artificial Sequence
  Description of Artificial Sequence: Synthetic oligonucleotide
uugagugcgc

SEQ ID NO: 1472 - RNA, 10 nt, Artificial Sequence
  Description of Artificial Sequence: Synthetic oligonucleotide
  modified_base (2)..(2): a, c, u, g, unknown or other
angagugggc

SEQ ID NO: 1473 - RNA, 10 nt, Artificial Sequence
  Description of Artificial Sequence: Synthetic oligonucleotide
  modified_base (2)..(2): a, c, u, g, unknown or other
angagugugc

SEQ ID NO: 1474 - RNA, 10 nt, Artificial Sequence
  Description of Artificial Sequence: Synthetic oligonucleotide
  modified_base (2)..(2): a, c, u, g, unknown or other
angagugagg

SEQ ID NO: 1475 - RNA, 10 nt, Artificial Sequence
  Description of Artificial Sequence: Synthetic oligonucleotide
  modified_base (2)..(2): a, c, u, g, unknown or other
angagugcgg

SEQ ID NO: 1476 - RNA, 10 nt, Artificial Sequence
  Description of Artificial Sequence: Synthetic oligonucleotide
  modified_base (1)..(1): a, c, u, g, unknown or other
nagagugggc

SEQ ID NO: 1477 - RNA, 10 nt, Artificial Sequence
  Description of Artificial Sequence: Synthetic oligonucleotide
  modified_base (1)..(1): a, c, u, g, unknown or other
nagagugugc

SEQ ID NO: 1478 - RNA, 10 nt, Artificial Sequence
  Description of Artificial Sequence: Synthetic oligonucleotide
  modified_base (1)..(1): a, c, u, g, unknown or other
nagagugagg

SEQ ID NO: 1479 - RNA, 10 nt, Artificial Sequence
  Description of Artificial Sequence: Synthetic oligonucleotide
  modified_base (1)..(1): a, c, u, g, unknown or other
nagagugcgg

SEQ ID NO: 1480 - RNA, 10 nt, Artificial Sequence
  Description of Artificial Sequence: Synthetic oligonucleotide
aagagugggc

SEQ ID NO: 1481 - RNA, 10 nt, Artificial Sequence
  Description of Artificial Sequence: Synthetic oligonucleotide
aagagugugc

SEQ ID NO: 1482 - RNA, 10 nt, Artificial Sequence
  Description of Artificial Sequence: Synthetic oligonucleotide
aagagugagg

SEQ ID NO: 1483 - RNA, 10 nt, Artificial Sequence
  Description of Artificial Sequence: Synthetic oligonucleotide
aagagugcgg

SEQ ID NO: 1484 - RNA, 10 nt, Artificial Sequence
  Description of Artificial Sequence: Synthetic oligonucleotide
cagagugggc

SEQ ID NO: 1485 - RNA, 10 nt, Artificial Sequence
  Description of Artificial Sequence: Synthetic oligonucleotide
cagagugugc

SEQ ID NO: 1486 - RNA, 10 nt, Artificial Sequence
  Description of Artificial Sequence: Synthetic oligonucleotide
cagagugagg

SEQ ID NO: 1487 - RNA, 10 nt, Artificial Sequence
  Description of Artificial Sequence: Synthetic oligonucleotide
cagagugcgg

SEQ ID NO: 1488 - RNA, 10 nt, Artificial Sequence
  Description of Artificial Sequence: Synthetic oligonucleotide
gagagugggc

SEQ ID NO: 1489 - RNA, 10 nt, Artificial Sequence
  Description of Artificial Sequence: Synthetic oligonucleotide
gagagugugc

SEQ ID NO: 1490 - RNA, 10 nt, Artificial Sequence
  Description of Artificial Sequence: Synthetic oligonucleotide
gagagugagg

SEQ ID NO: 1491 - RNA, 10 nt, Artificial Sequence
  Description of Artificial Sequence: Synthetic oligonucleotide
gagagugcgg

SEQ ID NO: 1492 - RNA, 10 nt, Artificial Sequence
  Description of Artificial Sequence: Synthetic oligonucleotide
uagagugggc

SEQ ID NO: 1493 - RNA, 10 nt, Artificial Sequence
  Description of Artificial Sequence: Synthetic oligonucleotide
uagagugugc

SEQ ID NO: 1494 - RNA, 10 nt, Artificial Sequence
  Description of Artificial Sequence: Synthetic oligonucleotide
uagagugagg

SEQ ID NO: 1495 - RNA, 10 nt, Artificial Sequence
  Description of Artificial Sequence: Synthetic oligonucleotide
uagagugcgg

SEQ ID NO: 1496 - RNA, 10 nt, Artificial Sequence
  Description of Artificial Sequence: Synthetic oligonucleotide
  modified_base (2)..(2): a, c, u, g, unknown or other
cngagugggc

SEQ ID NO: 1497 - RNA, 10 nt, Artificial Sequence
  Description of Artificial Sequence: Synthetic oligonucleotide
  modified_base (2)..(2): a, c, u, g, unknown or other
cngagugugc

SEQ ID NO: 1498 - RNA, 10 nt, Artificial Sequence
  Description of Artificial Sequence: Synthetic oligonucleotide
  modified_base (2)..(2): a, c, u, g, unknown or other
cngagugagg

SEQ ID NO: 1499 - RNA, 10 nt, Artificial Sequence
  Description of Artificial Sequence: Synthetic oligonucleotide
  modified_base (2)..(2): a, c, u, g, unknown or other
cngagugcgg

SEQ ID NO: 1500 - RNA, 10 nt, Artificial Sequence
  Description of Artificial Sequence: Synthetic oligonucleotide
  modified_base (1)..(1): a, c, u, g, unknown or other
ncgagugggc

SEQ ID NO: 1501 - RNA, 10 nt, Artificial Sequence
  Description of Artificial Sequence: Synthetic oligonucleotide
  modified_base (1)..(1): a, c, u, g, unknown or other
ncgagugugc

SEQ ID NO: 1502 - RNA, 10 nt, Artificial Sequence
  Description of Artificial Sequence: Synthetic oligonucleotide
  modified_base (1)..(1): a, c, u, g, unknown or other
ncgagugagg

SEQ ID NO: 1503 - RNA, 10 nt, Artificial Sequence
  Description of Artificial Sequence: Synthetic oligonucleotide
  modified_base (1)..(1): a, c, u, g, unknown or other
ncgagugcgg

SEQ ID NO: 1504 - RNA, 10 nt, Artificial Sequence
  Description of Artificial Sequence: Synthetic oligonucleotide
acgagugggc

SEQ ID NO: 1505 - RNA, 10 nt, Artificial Sequence
  Description of Artificial Sequence: Synthetic oligonucleotide
acgagugugc

SEQ ID NO: 1506 - RNA, 10 nt, Artificial Sequence
  Description of Artificial Sequence: Synthetic oligonucleotide
acgagugagg

SEQ ID NO: 1507 - RNA, 10 nt, Artificial Sequence
  Description of Artificial Sequence: Synthetic oligonucleotide
acgagugcgg

SEQ ID NO: 1508 - RNA, 10 nt, Artificial Sequence
  Description of Artificial Sequence: Synthetic oligonucleotide
ccgagugggc

SEQ ID NO: 1509 - RNA, 10 nt, Artificial Sequence
  Description of Artificial Sequence: Synthetic oligonucleotide
ccgagugugc

SEQ ID NO: 1510 - RNA, 10 nt, Artificial Sequence
  Description of Artificial Sequence: Synthetic oligonucleotide
ccgagugagg

SEQ ID NO: 1511 - RNA, 10 nt, Artificial Sequence
  Description of Artificial Sequence: Synthetic oligonucleotide
ccgagugcgg

SEQ ID NO: 1512 - RNA, 10 nt, Artificial Sequence
  Description of Artificial Sequence: Synthetic oligonucleotide
gcgagugggc

SEQ ID NO: 1513 - RNA, 10 nt, Artificial Sequence
  Description of Artificial Sequence: Synthetic oligonucleotide
gcgagugugc

SEQ ID NO: 1514 - RNA, 10 nt, Artificial Sequence
  Description of Artificial Sequence: Synthetic oligonucleotide
gcgagugagg

SEQ ID NO: 1515 - RNA, 10 nt, Artificial Sequence
  Description of Artificial Sequence: Synthetic oligonucleotide
gcgagugcgg

SEQ ID NO: 1516 - RNA, 10 nt, Artificial Sequence
  Description of Artificial Sequence: Synthetic oligonucleotide
ucgagugggc

SEQ ID NO: 1517 - RNA, 10 nt, Artificial Sequence
  Description of Artificial Sequence: Synthetic oligonucleotide
ucgagugugc

SEQ ID NO: 1518 - RNA, 10 nt, Artificial Sequence
  Description of Artificial Sequence: Synthetic oligonucleotide
ucgagugagg

SEQ ID NO: 1519 - RNA, 10 nt, Artificial Sequence
  Description of Artificial Sequence: Synthetic oligonucleotide
ucgagugcgg

SEQ ID NO: 1520 - RNA, 10 nt, Artificial Sequence
  Description of Artificial Sequence: Synthetic oligonucleotide
  modified_base (2)..(2): a, c, u, g, unknown or other
gngagugggc

SEQ ID NO: 1521 - RNA, 10 nt, Artificial Sequence
  Description of Artificial Sequence: Synthetic oligonucleotide
  modified_base (2)..(2): a, c, u, g, unknown or other
gngagugugc

SEQ ID NO: 1522 - RNA, 10 nt, Artificial Sequence
  Description of Artificial Sequence: Synthetic oligonucleotide
  modified_base (2)..(2): a, c, u, g, unknown or other
gngagugagg

SEQ ID NO: 1523 - RNA, 10 nt, Artificial Sequence
  Description of Artificial Sequence: Synthetic oligonucleotide
  modified_base (2)..(2): a, c, u, g, unknown or other
gngagugcgg

SEQ ID NO: 1524 - RNA, 10 nt, Artificial Sequence
  Description of Artificial Sequence: Synthetic oligonucleotide
  modified_base (1)..(1): a, c, u, g, unknown or other
nggagugggc

SEQ ID NO: 1525 - RNA, 10 nt, Artificial Sequence
  Description of Artificial Sequence: Synthetic oligonucleotide
  modified_base (1)..(1): a, c, u, g, unknown or other
nggagugugc

SEQ ID NO: 1526 - RNA, 10 nt, Artificial Sequence
  Description of Artificial Sequence: Synthetic oligonucleotide
  modified_base (1)..(1): a, c, u, g, unknown or other
nggagugagg

SEQ ID NO: 1527 - RNA, 10 nt, Artificial Sequence
  Description of Artificial Sequence: Synthetic oligonucleotide
  modified_base (1)..(1): a, c, u, g, unknown or other
nggagugcgg

SEQ ID NO: 1528 - RNA, 10 nt, Artificial Sequence
  Description of Artificial Sequence: Synthetic oligonucleotide
aggagugggc

SEQ ID NO: 1529 - RNA, 10 nt, Artificial Sequence
  Description of Artificial Sequence: Synthetic oligonucleotide
aggagugugc

SEQ ID NO: 1530 - RNA, 10 nt, Artificial Sequence
  Description of Artificial Sequence: Synthetic oligonucleotide
aggagugagg

SEQ ID NO: 1531 - RNA, 10 nt, Artificial Sequence
  Description of Artificial Sequence: Synthetic oligonucleotide
aggagugcgg

SEQ ID NO: 1532 - RNA, 10 nt, Artificial Sequence
  Description of Artificial Sequence: Synthetic oligonucleotide
cggagugggc

SEQ ID NO: 1533 - RNA, 10 nt, Artificial Sequence
  Description of Artificial Sequence: Synthetic oligonucleotide
cggagugugc

SEQ ID NO: 1534 - RNA, 10 nt, Artificial Sequence
  Description of Artificial Sequence: Synthetic oligonucleotide
cggagugagg

SEQ ID NO: 1535 - RNA, 10 nt, Artificial Sequence
  Description of Artificial Sequence: Synthetic oligonucleotide
cggagugcgg

SEQ ID NO: 1536 - RNA, 10 nt, Artificial Sequence
  Description of Artificial Sequence: Synthetic oligonucleotide
gggagugggc

SEQ ID NO: 1537 - RNA, 10 nt, Artificial Sequence
  Description of Artificial Sequence: Synthetic oligonucleotide
gggagugugc

SEQ ID NO: 1538 - RNA, 10 nt, Artificial Sequence
  Description of Artificial Sequence: Synthetic oligonucleotide
gggagugagg

SEQ ID NO: 1539 - RNA, 10 nt, Artificial Sequence
  Description of Artificial Sequence: Synthetic oligonucleotide
gggagugcgg

SEQ ID NO: 1540 - RNA, 10 nt, Artificial Sequence
  Description of Artificial Sequence: Synthetic oligonucleotide
uggagugggc

SEQ ID NO: 1541 - RNA, 10 nt, Artificial Sequence
  Description of Artificial Sequence: Synthetic oligonucleotide
uggagugugc

SEQ ID NO: 1542 - RNA, 10 nt, Artificial Sequence
  Description of Artificial Sequence: Synthetic oligonucleotide
uggagugagg

SEQ ID NO: 1543 - RNA, 10 nt, Artificial Sequence
  Description of Artificial Sequence: Synthetic oligonucleotide
uggagugcgg

SEQ ID NO: 1544 - RNA, 10 nt, Artificial Sequence
  Description of Artificial Sequence: Synthetic oligonucleotide
  modified_base (2)..(2): a, c, u, g, unknown or other
ungagugggc

SEQ ID NO: 1545 - RNA, 10 nt, Artificial Sequence
  Description of Artificial Sequence: Synthetic oligonucleotide
  modified_base (2)..(2): a, c, u, g, unknown or other
ungagugugc

SEQ ID NO: 1546 - RNA, 10 nt, Artificial Sequence
  Description of Artificial Sequence: Synthetic oligonucleotide
  modified_base (2)..(2): a, c, u, g, unknown or other
ungagugagg

SEQ ID NO: 1547 - RNA, 10 nt, Artificial Sequence
  Description of Artificial Sequence: Synthetic oligonucleotide
  modified_base (2)..(2): a, c, u, g, unknown or other
ungagugcgg

SEQ ID NO: 1548 - RNA, 10 nt, Artificial Sequence
  Description of Artificial Sequence: Synthetic oligonucleotide
  modified_base (1)..(1): a, c, u, g, unknown or other
nugagugggc

SEQ ID NO: 1549 - RNA, 10 nt, Artificial Sequence
  Description of Artificial Sequence: Synthetic oligonucleotide
  modified_base (1)..(1): a, c, u, g, unknown or other
nugagugugc

SEQ ID NO: 1550 - RNA, 10 nt, Artificial Sequence
  Description of Artificial Sequence: Synthetic oligonucleotide
  modified_base (1)..(1): a, c, u, g, unknown or other
nugagugagg

SEQ ID NO: 1551 - RNA, 10 nt, Artificial Sequence
  Description of Artificial Sequence: Synthetic oligonucleotide
  modified_base (1)..(1): a, c, u, g, unknown or other
nugagugcgg

SEQ ID NO: 1552 - RNA, 10 nt, Artificial Sequence
  Description of Artificial Sequence: Synthetic oligonucleotide
augagugggc

SEQ ID NO: 1553 - RNA, 10 nt, Artificial Sequence
  Description of Artificial Sequence: Synthetic oligonucleotide
augagugugc

SEQ ID NO: 1554 - RNA, 10 nt, Artificial Sequence
  Description of Artificial Sequence: Synthetic oligonucleotide
augagugagg

SEQ ID NO: 1555 - RNA, 10 nt, Artificial Sequence
  Description of Artificial Sequence: Synthetic oligonucleotide
augagugcgg

SEQ ID NO: 1556 - RNA, 10 nt, Artificial Sequence
  Description of Artificial Sequence: Synthetic oligonucleotide
cugagugggc

SEQ ID NO: 1557 - RNA, 10 nt, Artificial Sequence
  Description of Artificial Sequence: Synthetic oligonucleotide
cugagugugc

SEQ ID NO: 1558 - RNA, 10 nt, Artificial Sequence
  Description of Artificial Sequence: Synthetic oligonucleotide
cugagugagg

SEQ ID NO: 1559 - RNA, 10 nt, Artificial Sequence
  Description of Artificial Sequence: Synthetic oligonucleotide
cugagugcgg

SEQ ID NO: 1560 - RNA, 10 nt, Artificial Sequence
  Description of Artificial Sequence: Synthetic oligonucleotide
gugagugggc

SEQ ID NO: 1561 - RNA, 10 nt, Artificial Sequence
  Description of Artificial Sequence: Synthetic oligonucleotide
gugagugugc

SEQ ID NO: 1562 - RNA, 10 nt, Artificial Sequence
  Description of Artificial Sequence: Synthetic oligonucleotide
gugagugagg

SEQ ID NO: 1563 - RNA, 10 nt, Artificial Sequence
  Description of Artificial Sequence: Synthetic oligonucleotide
gugagugcgg

SEQ ID NO: 1564 - RNA, 10 nt, Artificial Sequence
  Description of Artificial Sequence: Synthetic oligonucleotide
uugagugggc

SEQ ID NO: 1565 - RNA, 10 nt, Artificial Sequence
  Description of Artificial Sequence: Synthetic oligonucleotide
uugagugugc

SEQ ID NO: 1566 - RNA, 10 nt, Artificial Sequence
  Description of Artificial Sequence: Synthetic oligonucleotide
uugagugagg

SEQ ID NO: 1567 - RNA, 10 nt, Artificial Sequence
  Description of Artificial Sequence: Synthetic oligonucleotide
uugagugcgg

SEQ ID NO: 1568 - RNA, 10 nt, Artificial Sequence
  Description of Artificial Sequence: Synthetic oligonucleotide
  modified_base (2)..(2): a, c, u, g, unknown or other
angagugggg

SEQ ID NO: 1569 - RNA, 10 nt, Artificial Sequence
  Description of Artificial Sequence: Synthetic oligonucleotide
  modified_base (2)..(2): a, c, u, g, unknown or other
angagugugg

SEQ ID NO: 1570 - RNA, 10 nt, Artificial Sequence
  Description of Artificial Sequence: Synthetic oligonucleotide
  modified_base (2)..(2): a, c, u, g, unknown or other
angagugagu

SEQ ID NO: 1571 - RNA, 10 nt, Artificial Sequence
  Description of Artificial Sequence: Synthetic oligonucleotide
  modified_base (2)..(2): a, c, u, g, unknown or other
angagugcgu

SEQ ID NO: 1572 - RNA, 10 nt, Artificial Sequence
  Description of Artificial Sequence: Synthetic oligonucleotide
  modified_base (1)..(1): a, c, u, g, unknown or other
nagagugggg

SEQ ID NO: 1573 - RNA, 10 nt, Artificial Sequence
  Description of Artificial Sequence: Synthetic oligonucleotide
  modified_base (1)..(1): a, c, u, g, unknown or other
nagagugugg

SEQ ID NO: 1574 - RNA, 10 nt, Artificial Sequence
  Description of Artificial Sequence: Synthetic oligonucleotide
  modified_base (1)..(1): a, c, u, g, unknown or other
nagagugagu

SEQ ID NO: 1575 - RNA, 10 nt, Artificial Sequence
  Description of Artificial Sequence: Synthetic oligonucleotide
  modified_base (1)..(1): a, c, u, g, unknown or other
nagagugcgu

SEQ ID NO: 1576 - RNA, 10 nt, Artificial Sequence
  Description of Artificial Sequence: Synthetic oligonucleotide
aagagugggg

SEQ ID NO: 1577 - RNA, 10 nt, Artificial Sequence
  Description of Artificial Sequence: Synthetic oligonucleotide
aagagugugg

SEQ ID NO: 1578 - RNA, 10 nt, Artificial Sequence
  Description of Artificial Sequence: Synthetic oligonucleotide
aagagugagu

SEQ ID NO: 1579 - RNA, 10 nt, Artificial Sequence
  Description of Artificial Sequence: Synthetic oligonucleotide
aagagugcgu

SEQ ID NO: 1580 - RNA, 10 nt, Artificial Sequence
  Description of Artificial Sequence: Synthetic oligonucleotide
cagagugggg

SEQ ID NO: 1581 - RNA, 10 nt, Artificial Sequence
  Description of Artificial Sequence: Synthetic oligonucleotide
cagagugugg

SEQ ID NO: 1582 - RNA, 10 nt, Artificial Sequence
  Description of Artificial Sequence: Synthetic oligonucleotide
cagagugagu

SEQ ID NO: 1583 - RNA, 10 nt, Artificial Sequence
  Description of Artificial Sequence: Synthetic oligonucleotide
cagagugcgu

SEQ ID NO: 1584 - RNA, 10 nt, Artificial Sequence
  Description of Artificial Sequence: Synthetic oligonucleotide
gagagugggg

SEQ ID NO: 1585 - RNA, 10 nt, Artificial Sequence
  Description of Artificial Sequence: Synthetic oligonucleotide
gagagugugg

SEQ ID NO: 1586 - RNA, 10 nt, Artificial Sequence
  Description of Artificial Sequence: Synthetic oligonucleotide
gagagugagu

SEQ ID NO: 1587 - RNA, 10 nt, Artificial Sequence
  Description of Artificial Sequence: Synthetic oligonucleotide
gagagugcgu

SEQ ID NO: 1588 - RNA, 10 nt, Artificial Sequence
  Description of Artificial Sequence: Synthetic oligonucleotide
uagagugggg

SEQ ID NO: 1589 - RNA, 10 nt, Artificial Sequence
  Description of Artificial Sequence: Synthetic oligonucleotide
uagagugugg

SEQ ID NO: 1590 - RNA, 10 nt, Artificial Sequence
  Description of Artificial Sequence: Synthetic oligonucleotide
uagagugagu

SEQ ID NO: 1591 - RNA, 10 nt, Artificial Sequence
  Description of Artificial Sequence: Synthetic oligonucleotide
uagagugcgu

SEQ ID NO: 1592 - RNA, 10 nt, Artificial Sequence
  Description of Artificial Sequence: Synthetic oligonucleotide
  modified_base (2)..(2): a, c, u, g, unknown or other
cngagugggg

SEQ ID NO: 1593 - RNA, 10 nt, Artificial Sequence
  Description of Artificial Sequence: Synthetic oligonucleotide
  modified_base (2)..(2): a, c, u, g, unknown or other
cngagugugg

SEQ ID NO: 1594 - RNA, 10 nt, Artificial Sequence
  Description of Artificial Sequence: Synthetic oligonucleotide
  modified_base (2)..(2): a, c, u, g, unknown or other
cngagugagu

SEQ ID NO: 1595 - RNA, 10 nt, Artificial Sequence
  Description of Artificial Sequence: Synthetic oligonucleotide
  modified_base (2)..(2): a, c, u, g, unknown or other
cngagugcgu

SEQ ID NO: 1596 - RNA, 10 nt, Artificial Sequence
  Description of Artificial Sequence: Synthetic oligonucleotide
  modified_base (1)..(1): a, c, u, g, unknown or other
ncgagugggg

SEQ ID NO: 1597 - RNA, 10 nt, Artificial Sequence
  Description of Artificial Sequence: Synthetic oligonucleotide
  modified_base (1)..(1): a, c, u, g, unknown or other
ncgagugugg

SEQ ID NO: 1598 - RNA, 10 nt, Artificial Sequence
  Description of Artificial Sequence: Synthetic oligonucleotide
  modified_base (1)..(1): a, c, u, g, unknown or other
ncgagugagu

SEQ ID NO: 1599 - RNA, 10 nt, Artificial Sequence
  Description of Artificial Sequence: Synthetic oligonucleotide
  modified_base (1)..(1): a, c, u, g, unknown or other
ncgagugcgu

SEQ ID NO: 1600 - RNA, 10 nt, Artificial Sequence
  Description of Artificial Sequence: Synthetic oligonucleotide
acgagugggg

SEQ ID NO: 1601 - RNA, 10 nt, Artificial Sequence
  Description of Artificial Sequence: Synthetic oligonucleotide
acgagugugg

SEQ ID NO: 1602 - RNA, 10 nt, Artificial Sequence
  Description of Artificial Sequence: Synthetic oligonucleotide
acgagugagu

SEQ ID NO: 1603 - RNA, 10 nt, Artificial Sequence
  Description of Artificial Sequence: Synthetic oligonucleotide
acgagugcgu

SEQ ID NO: 1604 - RNA, 10 nt, Artificial Sequence
  Description of Artificial Sequence: Synthetic oligonucleotide
ccgagugggg

SEQ ID NO: 1605 - RNA, 10 nt, Artificial Sequence
  Description of Artificial Sequence: Synthetic oligonucleotide
ccgagugugg

SEQ ID NO: 1606 - RNA, 10 nt, Artificial Sequence
  Description of Artificial Sequence: Synthetic oligonucleotide
ccgagugagu

SEQ ID NO: 1607 - RNA, 10 nt, Artificial Sequence
  Description of Artificial Sequence: Synthetic oligonucleotide
ccgagugcgu

SEQ ID NO: 1608 - RNA, 10 nt, Artificial Sequence
  Description of Artificial Sequence: Synthetic oligonucleotide
gcgagugggg

SEQ ID NO: 1609 - RNA, 10 nt, Artificial Sequence
  Description of Artificial Sequence: Synthetic oligonucleotide
gcgagugugg

SEQ ID NO: 1610 - RNA, 10 nt, Artificial Sequence
  Description of Artificial Sequence: Synthetic oligonucleotide
gcgagugagu

SEQ ID NO: 1611 - RNA, 10 nt, Artificial Sequence
  Description of Artificial Sequence: Synthetic oligonucleotide
gcgagugcgu

SEQ ID NO: 1612 - RNA, 10 nt, Artificial Sequence
  Description of Artificial Sequence: Synthetic oligonucleotide
ucgagugggg

SEQ ID NO: 1613 - RNA, 10 nt, Artificial Sequence
  Description of Artificial Sequence: Synthetic oligonucleotide
ucgagugugg

SEQ ID NO: 1614 - RNA, 10 nt, Artificial Sequence
  Description of Artificial Sequence: Synthetic oligonucleotide
ucgagugagu

SEQ ID NO: 1615 - RNA, 10 nt, Artificial Sequence
  Description of Artificial Sequence: Synthetic oligonucleotide
ucgagugcgu

SEQ ID NO: 1616 - RNA, 10 nt, Artificial Sequence
  Description of Artificial Sequence: Synthetic oligonucleotide
  modified_base (2)..(2): a, c, u, g, unknown or other
gngagugggg

SEQ ID NO: 1617 - RNA, 10 nt, Artificial Sequence
  Description of Artificial Sequence: Synthetic oligonucleotide
  modified_base (2)..(2): a, c, u, g, unknown or other
gngagugugg

SEQ ID NO: 1618 - RNA, 10 nt, Artificial Sequence
  Description of Artificial Sequence: Synthetic oligonucleotide
  modified_base (2)..(2): a, c, u, g, unknown or other
gngagugagu

SEQ ID NO: 1619 - RNA, 10 nt, Artificial Sequence
  Description of Artificial Sequence: Synthetic oligonucleotide
  modified_base (2)..(2): a, c, u, g, unknown or other
gngagugcgu

SEQ ID NO: 1620 - RNA, 10 nt, Artificial Sequence
  Description of Artificial Sequence: Synthetic oligonucleotide
  modified_base (1)..(1): a, c, u, g, unknown or other
nggagugggg

SEQ ID NO: 1621 - RNA, 10 nt, Artificial Sequence
  Description of Artificial Sequence: Synthetic oligonucleotide
  modified_base (1)..(1): a, c, u, g, unknown or other
nggagugugg

SEQ ID NO: 1622 - RNA, 10 nt, Artificial Sequence
  Description of Artificial Sequence: Synthetic oligonucleotide
  modified_base (1)..(1): a, c, u, g, unknown or other
nggagugagu

SEQ ID NO: 1623 - RNA, 10 nt, Artificial Sequence
  Description of Artificial Sequence: Synthetic oligonucleotide
  modified_base (1)..(1): a, c, u, g, unknown or other
nggagugcgu

SEQ ID NO: 1624 - RNA, 10 nt, Artificial Sequence
  Description of Artificial Sequence: Synthetic oligonucleotide
aggagugggg

SEQ ID NO: 1625 - RNA, 10 nt, Artificial Sequence
  Description of Artificial Sequence: Synthetic oligonucleotide
aggagugugg

SEQ ID NO: 1626 - RNA, 10 nt, Artificial Sequence
  Description of Artificial Sequence: Synthetic oligonucleotide
aggagugagu

SEQ ID NO: 1627 - RNA, 10 nt, Artificial Sequence
  Description of Artificial Sequence: Synthetic oligonucleotide
aggagugcgu

SEQ ID NO: 1628 - RNA, 10 nt, Artificial Sequence
  Description of Artificial Sequence: Synthetic oligonucleotide
cggagugggg

SEQ ID NO: 1629 - RNA, 10 nt, Artificial Sequence
  Description of Artificial Sequence: Synthetic oligonucleotide
cggagugugg

SEQ ID NO: 1630 - RNA, 10 nt, Artificial Sequence
  Description of Artificial Sequence: Synthetic oligonucleotide
cggagugagu

SEQ ID NO: 1631 - RNA, 10 nt, Artificial Sequence
  Description of Artificial Sequence: Synthetic oligonucleotide
cggagugcgu

SEQ ID NO: 1632 - RNA, 10 nt, Artificial Sequence
  Description of Artificial Sequence: Synthetic oligonucleotide
gggagugggg

SEQ ID NO: 1633 - RNA, 10 nt, Artificial Sequence
  Description of Artificial Sequence: Synthetic oligonucleotide
gggagugugg

SEQ ID NO: 1634 - RNA, 10 nt, Artificial Sequence
  Description of Artificial Sequence: Synthetic oligonucleotide
gggagugagu

SEQ ID NO: 1635 - RNA, 10 nt, Artificial Sequence
  Description of Artificial Sequence: Synthetic oligonucleotide
gggagugcgu

SEQ ID NO: 1636 - RNA, 10 nt, Artificial Sequence
  Description of Artificial Sequence: Synthetic oligonucleotide
uggagugggg

SEQ ID NO: 1637 - RNA, 10 nt, Artificial Sequence
  Description of Artificial Sequence: Synthetic oligonucleotide
uggagugugg

SEQ ID NO: 1638 - RNA, 10 nt, Artificial Sequence
  Description of Artificial Sequence: Synthetic oligonucleotide
uggagugagu

SEQ ID NO: 1639 - RNA, 10 nt, Artificial Sequence
  Description of Artificial Sequence: Synthetic oligonucleotide
uggagugcgu

SEQ ID NO: 1640 - RNA, 10 nt, Artificial Sequence
  Description of Artificial Sequence: Synthetic oligonucleotide
  modified_base (2)..(2): a, c, u, g, unknown or other
ungagugggg

SEQ ID NO: 1641 - RNA, 10 nt, Artificial Sequence
  Description of Artificial Sequence: Synthetic oligonucleotide
  modified_base (2)..(2): a, c, u, g, unknown or other
ungagugugg

SEQ ID NO: 1642 - RNA, 10 nt, Artificial Sequence
  Description of Artificial Sequence: Synthetic oligonucleotide
  modified_base (2)..(2): a, c, u, g, unknown or other
ungagugagu

SEQ ID NO: 1643 - RNA, 10 nt, Artificial Sequence
  Description of Artificial Sequence: Synthetic oligonucleotide
  modified_base (2)..(2): a, c, u, g, unknown or other
ungagugcgu

SEQ ID NO: 1644 - RNA, 10 nt, Artificial Sequence
  Description of Artificial Sequence: Synthetic oligonucleotide
  modified_base (1)..(1): a, c, u, g, unknown or other
nugagugggg

SEQ ID NO: 1645 - RNA, 10 nt, Artificial Sequence
  Description of Artificial Sequence: Synthetic oligonucleotide
  modified_base (1)..(1): a, c, u, g, unknown or other
nugagugugg

SEQ ID NO: 1646 - RNA, 10 nt, Artificial Sequence
  Description of Artificial Sequence: Synthetic oligonucleotide
  modified_base (1)..(1): a, c, u, g, unknown or other
nugagugagu

SEQ ID NO: 1647 - RNA, 10 nt, Artificial Sequence
  Description of Artificial Sequence: Synthetic oligonucleotide
  modified_base (1)..(1): a, c, u, g, unknown or other
nugagugcgu

SEQ ID NO: 1648 - RNA, 10 nt, Artificial Sequence
  Description of Artificial Sequence: Synthetic oligonucleotide
augagugggg

SEQ ID NO: 1649 - RNA, 10 nt, Artificial Sequence
  Description of Artificial Sequence: Synthetic oligonucleotide
augagugugg

SEQ ID NO: 1650 - RNA, 10 nt, Artificial Sequence
  Description of Artificial Sequence: Synthetic oligonucleotide
augagugagu

SEQ ID NO: 1651 - RNA, 10 nt, Artificial Sequence
  Description of Artificial Sequence: Synthetic oligonucleotide
augagugcgu

SEQ ID NO: 1652 - RNA, 10 nt, Artificial Sequence
  Description of Artificial Sequence: Synthetic oligonucleotide
cugagugggg

SEQ ID NO: 1653 - RNA, 10 nt, Artificial Sequence
  Description of Artificial Sequence: Synthetic oligonucleotide
cugagugugg

SEQ ID NO: 1654 - RNA, 10 nt, Artificial Sequence
  Description of Artificial Sequence: Synthetic oligonucleotide
cugagugagu

SEQ ID NO: 1655 - RNA, 10 nt, Artificial Sequence
  Description of Artificial Sequence: Synthetic oligonucleotide
cugagugcgu

SEQ ID NO: 1656 - RNA, 10 nt, Artificial Sequence
  Description of Artificial Sequence: Synthetic oligonucleotide
gugagugggg

SEQ ID NO: 1657 - RNA, 10 nt, Artificial Sequence
  Description of Artificial Sequence: Synthetic oligonucleotide
gugagugugg

SEQ ID NO: 1658 - RNA, 10 nt, Artificial Sequence
  Description of Artificial Sequence: Synthetic oligonucleotide
gugagugagu

SEQ ID NO: 1659 - RNA, 10 nt, Artificial Sequence
  Description of Artificial Sequence: Synthetic oligonucleotide
gugagugcgu

SEQ ID NO: 1660 - RNA, 10 nt, Artificial Sequence
  Description of Artificial Sequence: Synthetic oligonucleotide
uugagugggg

SEQ ID NO: 1661 - RNA, 10 nt, Artificial Sequence
  Description of Artificial Sequence: Synthetic oligonucleotide
uugagugugg

SEQ ID NO: 1662 - RNA, 10 nt, Artificial Sequence
  Description of Artificial Sequence: Synthetic oligonucleotide
uugagugagu

SEQ ID NO: 1663 - RNA, 10 nt, Artificial Sequence
  Description of Artificial Sequence: Synthetic oligonucleotide
uugagugcgu

SEQ ID NO: 1664 - RNA, 10 nt, Artificial Sequence
  Description of Artificial Sequence: Synthetic oligonucleotide
  modified_base (2)..(2): a, c, u, g, unknown or other
angagugggu

SEQ ID NO: 1665 - RNA, 10 nt, Artificial Sequence
  Description of Artificial Sequence: Synthetic oligonucleotide
  modified_base (2)..(2): a, c, u, g, unknown or other
angagugugu

SEQ ID NO: 1666 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
angagugnga

SEQ ID NO: 1667 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
angagugngc

SEQ ID NO: 1668 - RNA, 10 nt, Artificial Sequence
  Description of Artificial Sequence: Synthetic oligonucleotide
  modified_base (1)..(1): a, c, u, g, unknown or other
nagagugggu

SEQ ID NO: 1669 - RNA, 10 nt, Artificial Sequence
  Description of Artificial Sequence: Synthetic oligonucleotide
  modified_base (1)..(1): a, c, u, g, unknown or other
nagagugugu

SEQ ID NO: 1670 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
nagagugnga

SEQ ID NO: 1671 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
nagagugngc

SEQ ID NO: 1672 - RNA, 10 nt, Artificial Sequence
  Description of Artificial Sequence: Synthetic oligonucleotide
aagagugggu

SEQ ID NO: 1673 - RNA, 10 nt, Artificial Sequence
  Description of Artificial Sequence: Synthetic oligonucleotide
aagagugugu

SEQ ID NO: 1674 - RNA, 10 nt, Artificial Sequence
  Description of Artificial Sequence: Synthetic oligonucleotide
  modified_base (8)..(8): a, c, u, g, unknown or other
aagagugnga

SEQ ID NO: 1675 - RNA, 10 nt, Artificial Sequence
  Description of Artificial Sequence: Synthetic oligonucleotide
  modified_base (8)..(8): a, c, u, g, unknown or other
aagagugngc

SEQ ID NO: 1676 - RNA, 10 nt, Artificial Sequence
  Description of Artificial Sequence: Synthetic oligonucleotide
cagagugggu

SEQ ID NO: 1677 - RNA, 10 nt, Artificial Sequence
  Description of Artificial Sequence: Synthetic oligonucleotide
cagagugugu

SEQ ID NO: 1678 - RNA, 10 nt, Artificial Sequence
  Description of Artificial Sequence: Synthetic oligonucleotide
  modified_base (8)..(8): a, c, u, g, unknown or other
cagagugnga

SEQ ID NO: 1679 - RNA, 10 nt, Artificial Sequence
  Description of Artificial Sequence: Synthetic oligonucleotide
  modified_base (8)..(8): a, c, u, g, unknown or other
cagagugngc

SEQ ID NO: 1680 - RNA, 10 nt, Artificial Sequence
  Description of Artificial Sequence: Synthetic oligonucleotide
gagagugggu

SEQ ID NO: 1681 - RNA, 10 nt, Artificial Sequence
  Description of Artificial Sequence: Synthetic oligonucleotide
gagagugugu

SEQ ID NO: 1682 - RNA, 10 nt, Artificial Sequence
  Description of Artificial Sequence: Synthetic oligonucleotide
  modified_base (8)..(8): a, c, u, g, unknown or other
gagagugnga

SEQ ID NO: 1683 - RNA, 10 nt, Artificial Sequence
  Description of Artificial Sequence: Synthetic oligonucleotide
  modified_base (8)..(8): a, c, u, g, unknown or other
gagagugngc

SEQ ID NO: 1684 - RNA, 10 nt, Artificial Sequence
  Description of Artificial Sequence: Synthetic oligonucleotide
uagagugggu

SEQ ID NO: 1685 - RNA, 10 nt, Artificial Sequence
  Description of Artificial Sequence: Synthetic oligonucleotide
uagagugugu

SEQ ID NO: 1686 - RNA, 10 nt, Artificial Sequence
  Description of Artificial Sequence: Synthetic oligonucleotide
  modified_base (8)..(8): a, c, u, g, unknown or other
uagagugnga

SEQ ID NO: 1687 - RNA, 10 nt, Artificial Sequence
  Description of Artificial Sequence: Synthetic oligonucleotide
  modified_base (8)..(8): a, c, u, g, unknown or other
uagagugngc

SEQ ID NO: 1688 - RNA, 10 nt, Artificial Sequence
  Description of Artificial Sequence: Synthetic oligonucleotide
  modified_base (2)..(2): a, c, u, g, unknown or other
cngagugggu

SEQ ID NO: 1689 - RNA, 10 nt, Artificial Sequence
  Description of Artificial Sequence: Synthetic oligonucleotide
  modified_base (2)..(2): a, c, u, g, unknown or other
cngagugugu

SEQ ID NO: 1690 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
cngagugnga

SEQ ID NO: 1691 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
cngagugngc

SEQ ID NO: 1692 - RNA, 10 nt, Artificial Sequence
  Description of Artificial Sequence: Synthetic oligonucleotide
  modified_base (1)..(1): a, c, u, g, unknown or other
ncgagugggu

SEQ ID NO: 1693 - RNA, 10 nt, Artificial Sequence
  Description of Artificial Sequence: Synthetic oligonucleotide
  modified_base (1)..(1): a, c, u, g, unknown or other
ncgagugugu

SEQ ID NO: 1694 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
ncgagugnga

SEQ ID NO: 1695 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
ncgagugngc

SEQ ID NO: 1696 - RNA, 10 nt, Artificial Sequence
  Description of Artificial Sequence: Synthetic oligonucleotide
acgagugggu

SEQ ID NO: 1697 - RNA, 10 nt, Artificial Sequence
  Description of Artificial Sequence: Synthetic oligonucleotide
acgagugugu

SEQ ID NO: 1698 - RNA, 10 nt, Artificial Sequence
  Description of Artificial Sequence: Synthetic oligonucleotide
  modified_base (8)..(8): a, c, u, g, unknown or other
acgagugnga

SEQ ID NO: 1699 - RNA, 10 nt, Artificial Sequence
  Description of Artificial Sequence: Synthetic oligonucleotide
  modified_base (8)..(8): a, c, u, g, unknown or other
acgagugngc

SEQ ID NO: 1700 - RNA, 10 nt, Artificial Sequence
  Description of Artificial Sequence: Synthetic oligonucleotide
ccgagugggu

SEQ ID NO: 1701 - RNA, 10 nt, Artificial Sequence
  Description of Artificial Sequence: Synthetic oligonucleotide
ccgagugugu

SEQ ID NO: 1702 - RNA, 10 nt, Artificial Sequence
  Description of Artificial Sequence: Synthetic oligonucleotide
  modified_base (8)..(8): a, c, u, g, unknown or other
ccgagugnga

SEQ ID NO: 1703 - RNA, 10 nt, Artificial Sequence
  Description of Artificial Sequence: Synthetic oligonucleotide
  modified_base (8)..(8): a, c, u, g, unknown or other
ccgagugngc

SEQ ID NO: 1704 - RNA, 10 nt, Artificial Sequence
  Description of Artificial Sequence: Synthetic oligonucleotide
gcgagugggu

SEQ ID NO: 1705 - RNA, 10 nt, Artificial Sequence
  Description of Artificial Sequence: Synthetic oligonucleotide
gcgagugugu

SEQ ID NO: 1706 - RNA, 10 nt, Artificial Sequence
  Description of Artificial Sequence: Synthetic oligonucleotide
  modified_base (8)..(8): a, c, u, g, unknown or other
gcgagugnga

SEQ ID NO: 1707 - RNA, 10 nt, Artificial Sequence
  Description of Artificial Sequence: Synthetic oligonucleotide
  modified_base (8)..(8): a, c, u, g, unknown or other
gcgagugngc

SEQ ID NO: 1708 - RNA, 10 nt, Artificial Sequence
  Description of Artificial Sequence: Synthetic oligonucleotide
ucgagugggu

SEQ ID NO: 1709 - RNA, 10 nt, Artificial Sequence
  Description of Artificial Sequence: Synthetic oligonucleotide
ucgagugugu

SEQ ID NO: 1710 - RNA, 10 nt, Artificial Sequence
  Description of Artificial Sequence: Synthetic oligonucleotide
  modified_base (8)..(8): a, c, u, g, unknown or other
ucgagugnga

SEQ ID NO: 1711 - RNA, 10 nt, Artificial Sequence
  Description of Artificial Sequence: Synthetic oligonucleotide
  modified_base (8)..(8): a, c, u, g, unknown or other
ucgagugngc

SEQ ID NO: 1712 - RNA, 10 nt, Artificial Sequence
  Description of Artificial Sequence: Synthetic oligonucleotide
  modified_base (2)..(2): a, c, u, g, unknown or other
gngagugggu

SEQ ID NO: 1713 - RNA, 10 nt, Artificial Sequence
  Description of Artificial Sequence: Synthetic oligonucleotide
  modified_base (2)..(2): a, c, u, g, unknown or other
gngagugugu

SEQ ID NO: 1714 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
gngagugnga

SEQ ID NO: 1715 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
gngagugngc

SEQ ID NO: 1716 - RNA, 10 nt, Artificial Sequence
  Description of Artificial Sequence: Synthetic oligonucleotide
  modified_base (1)..(1): a, c, u, g, unknown or other
nggagugggu

SEQ ID NO: 1717 - RNA, 10 nt, Artificial Sequence
  Description of Artificial Sequence: Synthetic oligonucleotide
  modified_base (1)..(1): a, c, u, g, unknown or other
nggagugugu

SEQ ID NO: 1718 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
nggagugnga

SEQ ID NO: 1719 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
nggagugngc

SEQ ID NO: 1720 - RNA, 10 nt, Artificial Sequence
  Description of Artificial Sequence: Synthetic oligonucleotide
aggagugggu

SEQ ID NO: 1721 - RNA, 10 nt, Artificial Sequence
  Description of Artificial Sequence: Synthetic oligonucleotide
aggagugugu

SEQ ID NO: 1722 - RNA, 10 nt, Artificial Sequence
  Description of Artificial Sequence: Synthetic oligonucleotide
  modified_base (8)..(8): a, c, u, g, unknown or other
aggagugnga

SEQ ID NO: 1723 - RNA, 10 nt, Artificial Sequence
  Description of Artificial Sequence: Synthetic oligonucleotide
  modified_base (8)..(8): a, c, u, g, unknown or other
aggagugngc

SEQ ID NO: 1724 - RNA, 10 nt, Artificial Sequence
  Description of Artificial Sequence: Synthetic oligonucleotide
cggagugggu

SEQ ID NO: 1725 - RNA, 10 nt, Artificial Sequence
  Description of Artificial Sequence: Synthetic oligonucleotide
cggagugugu

SEQ ID NO: 1726 - RNA, 10 nt, Artificial Sequence
  Description of Artificial Sequence: Synthetic oligonucleotide
  modified_base (8)..(8): a, c, u, g, unknown or other
cggagugnga

SEQ ID NO: 1727 - RNA, 10 nt, Artificial Sequence
  Description of Artificial Sequence: Synthetic oligonucleotide
  modified_base (8)..(8): a, c, u, g, unknown or other
cggagugngc

SEQ ID NO: 1728 - RNA, 10 nt, Artificial Sequence
  Description of Artificial Sequence: Synthetic oligonucleotide
gggagugggu

SEQ ID NO: 1729 - RNA, 10 nt, Artificial Sequence
  Description of Artificial Sequence: Synthetic oligonucleotide
gggagugugu

SEQ ID NO: 1730 - RNA, 10 nt, Artificial Sequence
  Description of Artificial Sequence: Synthetic oligonucleotide
  modified_base (8)..(8): a, c, u, g, unknown or other
gggagugnga

SEQ ID NO: 1731 - RNA, 10 nt, Artificial Sequence
  Description of Artificial Sequence: Synthetic oligonucleotide
  modified_base (8)..(8): a, c, u, g, unknown or other
gggagugngc

SEQ ID NO: 1732 - RNA, 10 nt, Artificial Sequence
  Description of Artificial Sequence: Synthetic oligonucleotide
uggagugggu

SEQ ID NO: 1733 - RNA, 10 nt, Artificial Sequence
  Description of Artificial Sequence: Synthetic oligonucleotide
uggagugugu

SEQ ID NO: 1734 - RNA, 10 nt, Artificial Sequence
  Description of Artificial Sequence: Synthetic oligonucleotide
  modified_base (8)..(8): a, c, u, g, unknown or other
uggagugnga

SEQ ID NO: 1735 - RNA, 10 nt, Artificial Sequence
  Description of Artificial Sequence: Synthetic oligonucleotide
  modified_base (8)..(8): a, c, u, g, unknown or other
uggagugngc

SEQ ID NO: 1736 - RNA, 10 nt, Artificial Sequence
  Description of Artificial Sequence: Synthetic oligonucleotide
  modified_base (2)..(2): a, c, u, g, unknown or other
ungagugggu

SEQ ID NO: 1737 - RNA, 10 nt, Artificial Sequence
  Description of Artificial Sequence: Synthetic oligonucleotide
  modified_base (2)..(2): a, c, u, g, unknown or other
ungagugugu

SEQ ID NO: 1738 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
ungagugnga

SEQ ID NO: 1739 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
ungagugngc

SEQ ID NO: 1740 - RNA, 10 nt, Artificial Sequence
  Description of Artificial Sequence: Synthetic oligonucleotide
  modified_base (1)..(1): a, c, u, g, unknown or other
nugagugggu

SEQ ID NO: 1741 - RNA, 10 nt, Artificial Sequence
  Description of Artificial Sequence: Synthetic oligonucleotide
  modified_base (1)..(1): a, c, u, g, unknown or other
nugagugugu

SEQ ID NO: 1742 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
nugagugnga

SEQ ID NO: 1743 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
nugagugngc

SEQ ID NO: 1744 - RNA, 10 nt, Artificial Sequence
  Description of Artificial Sequence: Synthetic oligonucleotide
augagugggu

SEQ ID NO: 1745 - RNA, 10 nt, Artificial Sequence
  Description of Artificial Sequence: Synthetic oligonucleotide
augagugugu

SEQ ID NO: 1746 - RNA, 10 nt, Artificial Sequence
  Description of Artificial Sequence: Synthetic oligonucleotide
  modified_base (8)..(8): a, c, u, g, unknown or other
augagugnga

SEQ ID NO: 1747 - RNA, 10 nt, Artificial Sequence
  Description of Artificial Sequence: Synthetic oligonucleotide
  modified_base (8)..(8): a, c, u, g, unknown or other
augagugngc

SEQ ID NO: 1748 - RNA, 10 nt, Artificial Sequence
  Description of Artificial Sequence: Synthetic oligonucleotide
cugagugggu

SEQ ID NO: 1749 - RNA, 10 nt, Artificial Sequence
  Description of Artificial Sequence: Synthetic oligonucleotide
cugagugugu

SEQ ID NO: 1750 - RNA, 10 nt, Artificial Sequence
  Description of Artificial Sequence: Synthetic oligonucleotide
  modified_base (8)..(8): a, c, u, g, unknown or other
cugagugnga

SEQ ID NO: 1751 - RNA, 10 nt, Artificial Sequence
  Description of Artificial Sequence: Synthetic oligonucleotide
  modified_base (8)..(8): a, c, u, g, unknown or other
cugagugngc

SEQ ID NO: 1752 - RNA, 10 nt, Artificial Sequence
  Description of Artificial Sequence: Synthetic oligonucleotide
gugagugggu

SEQ ID NO: 1753 - RNA, 10 nt, Artificial Sequence
  Description of Artificial Sequence: Synthetic oligonucleotide
gugagugugu

SEQ ID NO: 1754 - RNA, 10 nt, Artificial Sequence
  Description of Artificial Sequence: Synthetic oligonucleotide
  modified_base (8)..(8): a, c, u, g, unknown or other
gugagugnga

SEQ ID NO: 1755 - RNA, 10 nt, Artificial Sequence
  Description of Artificial Sequence: Synthetic oligonucleotide
  modified_base (8)..(8): a, c, u, g, unknown or other
gugagugngc

SEQ ID NO: 1756 - RNA, 10 nt, Artificial Sequence
  Description of Artificial Sequence: Synthetic oligonucleotide
uugagugggu

SEQ ID NO: 1757 - RNA, 10 nt, Artificial Sequence
  Description of Artificial Sequence: Synthetic oligonucleotide
uugagugugu

SEQ ID NO: 1758 - RNA, 10 nt, Artificial Sequence
  Description of Artificial Sequence: Synthetic oligonucleotide
  modified_base (8)..(8): a, c, u, g, unknown or other
uugagugnga

SEQ ID NO: 1759 - RNA, 10 nt, Artificial Sequence
  Description of Artificial Sequence: Synthetic oligonucleotide
  modified_base (8)..(8): a, c, u, g, unknown or other
uugagugngc

SEQ ID NO: 1760 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
angagugngg

SEQ ID NO: 1761 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
gngagugngg

SEQ ID NO: 1762 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
angagugngu

SEQ ID NO: 1763 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
gngagugngu

SEQ ID NO: 1764 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
nagagugngg

SEQ ID NO: 1765 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
nggagugngg

SEQ ID NO: 1766 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
nagagugngu

SEQ ID NO: 1767 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
nggagugngu

SEQ ID NO: 1768 - RNA, 10 nt, Artificial Sequence
  Description of Artificial Sequence: Synthetic oligonucleotide
  modified_base (8)..(8): a, c, u, g, unknown or other
aagagugngg

SEQ ID NO: 1769 - RNA, 10 nt, Artificial Sequence
  Description of Artificial Sequence: Synthetic oligonucleotide
  modified_base (8)..(8): a, c, u, g, unknown or other
aggagugngg

SEQ ID NO: 1770 - RNA, 10 nt, Artificial Sequence
  Description of Artificial Sequence: Synthetic oligonucleotide
  modified_base (8)..(8): a, c, u, g, unknown or other
aagagugngu

SEQ ID NO: 1771 - RNA, 10 nt, Artificial Sequence
  Description of Artificial Sequence: Synthetic oligonucleotide
  modified_base (8)..(8): a, c, u, g, unknown or other
aggagugngu

SEQ ID NO: 1772 - RNA, 10 nt, Artificial Sequence
  Description of Artificial Sequence: Synthetic oligonucleotide
  modified_base (8)..(8): a, c, u, g, unknown or other
cagagugngg

SEQ ID NO: 1773 - RNA, 10 nt, Artificial Sequence
  Description of Artificial Sequence: Synthetic oligonucleotide
  modified_base (8)..(8): a, c, u, g, unknown or other
cggagugngg

SEQ ID NO: 1774 - RNA, 10 nt, Artificial Sequence
  Description of Artificial Sequence: Synthetic oligonucleotide
  modified_base (8)..(8): a, c, u, g, unknown or other
cagagugngu

SEQ ID NO: 1775 - RNA, 10 nt, Artificial Sequence
  Description of Artificial Sequence: Synthetic oligonucleotide
  modified_base (8)..(8): a, c, u, g, unknown or other
cggagugngu

SEQ ID NO: 1776 - RNA, 10 nt, Artificial Sequence
  Description of Artificial Sequence: Synthetic oligonucleotide
  modified_base (8)..(8): a, c, u, g, unknown or other
gagagugngg

SEQ ID NO: 1777 - RNA, 10 nt, Artificial Sequence
  Description of Artificial Sequence: Synthetic oligonucleotide
  modified_base (8)..(8): a, c, u, g, unknown or other
gggagugngg

SEQ ID NO: 1778 - RNA, 10 nt, Artificial Sequence
  Description of Artificial Sequence: Synthetic oligonucleotide
  modified_base (8)..(8): a, c, u, g, unknown or other
gagagugngu

SEQ ID NO: 1779 - RNA, 10 nt, Artificial Sequence
  Description of Artificial Sequence: Synthetic oligonucleotide
  modified_base (8)..(8): a, c, u, g, unknown or other
gggagugngu

SEQ ID NO: 1780 - RNA, 10 nt, Artificial Sequence
  Description of Artificial Sequence: Synthetic oligonucleotide
  modified_base (8)..(8): a, c, u, g, unknown or other
uagagugngg

SEQ ID NO: 1781 - RNA, 10 nt, Artificial Sequence
  Description of Artificial Sequence: Synthetic oligonucleotide
  modified_base (8)..(8): a, c, u, g, unknown or other
uggagugngg

SEQ ID NO: 1782 - RNA, 10 nt, Artificial Sequence
  Description of Artificial Sequence: Synthetic oligonucleotide
  modified_base (8)..(8): a, c, u, g, unknown or other
uagagugngu

SEQ ID NO: 1783 - RNA, 10 nt, Artificial Sequence
  Description of Artificial Sequence: Synthetic oligonucleotide
  modified_base (8)..(8): a, c, u, g, unknown or other
uggagugngu

SEQ ID NO: 1784 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
cngagugngg

SEQ ID NO: 1785 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
ungagugngg

SEQ ID NO: 1786 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
cngagugngu

SEQ ID NO: 1787 - RNA, 10 nt, Artificial Sequence
  Description of Artificial Sequence: Synthetic oligonucleotide
  modified_base (2)..(2): a, c, u, g, unknown or other
  modified_base (8)..(8): a, c, u, g, unknown or other
ungagugngu

SEQ ID NO: 1788 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
ncgagugngg

SEQ ID NO: 1789 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
nugagugngg

SEQ ID NO: 1790 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
ncgagugngu

SEQ ID NO: 1791 - RNA, 10 nt, Artificial Sequence
  Description of Artificial Sequence: Synthetic oligonucleotide
  modified_base (1)..(1): a, c, u, g, unknown or other
  modified_base (8)..(8): a, c, u, g, unknown or other
nugagugngu

SEQ ID NO: 1792 - RNA, 10 nt, Artificial Sequence
  Description of Artificial Sequence: Synthetic oligonucleotide
  modified_base (8)..(8): a, c, u, g, unknown or other
acgagugngg

SEQ ID NO: 1793 - RNA, 10 nt, Artificial Sequence
  Description of Artificial Sequence: Synthetic oligonucleotide
  modified_base (8)..(8): a, c, u, g, unknown or other
augagugngg

SEQ ID NO: 1794 - RNA, 10 nt, Artificial Sequence
  Description of Artificial Sequence: Synthetic oligonucleotide
  modified_base (8)..(8): a, c, u, g, unknown or other
acgagugngu

SEQ ID NO: 1795 - RNA, 10 nt, Artificial Sequence
  Description of Artificial Sequence: Synthetic oligonucleotide
  modified_base (8)..(8): a, c, u, g, unknown or other
augagugngu

SEQ ID NO: 1796 - RNA, 10 nt, Artificial Sequence
  Description of Artificial Sequence: Synthetic oligonucleotide
  modified_base (8)..(8): a, c, u, g, unknown or other
ccgagugngg

SEQ ID NO: 1797 - RNA, 10 nt, Artificial Sequence
  Description of Artificial Sequence: Synthetic oligonucleotide
  modified_base (8)..(8): a, c, u, g, unknown or other
cugagugngg

SEQ ID NO: 1798 - RNA, 10 nt, Artificial Sequence
  Description of Artificial Sequence: Synthetic oligonucleotide
  modified_base (8)..(8): a, c, u, g, unknown or other
ccgagugngu

SEQ ID NO: 1799 - RNA, 10 nt, Artificial Sequence
  Description of Artificial Sequence: Synthetic oligonucleotide
  modified_base (8)..(8): a, c, u, g, unknown or other
cugagugngu

SEQ ID NO: 1800 - RNA, 10 nt, Artificial Sequence
  Description of Artificial Sequence: Synthetic oligonucleotide
  modified_base (8)..(8): a, c, u, g, unknown or other
gcgagugngg

SEQ ID NO: 1801 - RNA, 10 nt, Artificial Sequence
  Description of Artificial Sequence: Synthetic oligonucleotide
  modified_base (8)..(8): a, c, u, g, unknown or other
gugagugngg

SEQ ID NO: 1802 - RNA, 10 nt, Artificial Sequence
  Description of Artificial Sequence: Synthetic oligonucleotide
  modified_base (8)..(8): a, c, u, g, unknown or other
gcgagugngu

SEQ ID NO: 1803 - RNA, 10 nt, Artificial Sequence
  Description of Artificial Sequence: Synthetic oligonucleotide
  modified_base (8)..(8): a, c, u, g, unknown or other
gugagugngu

SEQ ID NO: 1804 - RNA, 10 nt, Artificial Sequence
  Description of Artificial Sequence: Synthetic oligonucleotide
  modified_base (8)..(8): a, c, u, g, unknown or other
ucgagugngg

SEQ ID NO: 1805 - RNA, 10 nt, Artificial Sequence
  Description of Artificial Sequence: Synthetic oligonucleotide
  modified_base (8)..(8): a, c, u, g, unknown or other
uugagugngg

SEQ ID NO: 1806 - RNA, 10 nt, Artificial Sequence
  Description of Artificial Sequence: Synthetic oligonucleotide
  modified_base (8)..(8): a, c, u, g, unknown or other
ucgagugngu

SEQ ID NO: 1807 - RNA, 10 nt, Artificial Sequence
  Description of Artificial Sequence: Synthetic oligonucleotide
  modified_base (8)..(8): a, c, u, g, unknown or other
uugagugngu

SEQ ID NO: 1808 - DNA, 10 bp, Artificial Sequence
  Description of Artificial Sequence: Synthetic oligonucleotide
  modified_base (1)..(2): a, c, t, g, unknown or other
  modified_base (8)..(8): a, c, t, g, unknown or other
  modified_base (10)..(10): a, c, t, g, unknown or other
nngagtrngn

SEQ ID NO: 1809 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
  modified_base (10)..(10): a, c, t, g, unknown or other
angagtrngn

SEQ ID NO: 1810 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
  modified_base (10)..(10): a, c, t, g, unknown or other
cngagtrngn

SEQ ID NO: 1811 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
  modified_base (10)..(10): a, c, t, g, unknown or other
gngagtrngn

SEQ ID NO: 1812 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
  modified_base (10)..(10): a, c, t, g, unknown or other
tngagtrngn

SEQ ID NO: 1813 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
  modified_base (10)..(10): a, c, t, g, unknown or other
nagagtrngn

SEQ ID NO: 1814 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
  modified_base (10)..(10): a, c, t, g, unknown or other
ncgagtrngn

SEQ ID NO: 1815 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
  modified_base (10)..(10): a, c, t, g, unknown or other
nggagtrngn

SEQ ID NO: 1816 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
  modified_base (10)..(10): a, c, t, g, unknown or other
ntgagtrngn

SEQ ID NO: 1817 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
aagagtrngn

SEQ ID NO: 1818 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
acgagtrngn

SEQ ID NO: 1819 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
aggagtrngn

SEQ ID NO: 1820 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
atgagtrngn

SEQ ID NO: 1821 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
cagagtrngn

SEQ ID NO: 1822 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
ccgagtrngn

SEQ ID NO: 1823 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
cggagtrngn

SEQ ID NO: 1824 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
ctgagtrngn

SEQ ID NO: 1825 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
gagagtrngn

SEQ ID NO: 1826 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
gcgagtrngn

SEQ ID NO: 1827 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
gggagtrngn

SEQ ID NO: 1828 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
gtgagtrngn

SEQ ID NO: 1829 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
tagagtrngn

SEQ ID NO: 1830 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
tcgagtrngn

SEQ ID NO: 1831 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
tggagtrngn

SEQ ID NO: 1832 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
ttgagtrngn

SEQ ID NO: 1833 - DNA, 10 bp, Artificial Sequence
  Description of Artificial Sequence: Synthetic oligonucleotide
  modified_base (2)..(2): a, c, t, g, unknown or other
angagtragt

SEQ ID NO: 1834 - DNA, 10 bp, Artificial Sequence
  Description of Artificial Sequence: Synthetic oligonucleotide
  modified_base (2)..(2): a, c, t, g, unknown or other
cngagtragt

SEQ ID NO: 1835 - DNA, 10 bp, Artificial Sequence
  Description of Artificial Sequence: Synthetic oligonucleotide
  modified_base (2)..(2): a, c, t, g, unknown or other
gngagtragt

SEQ ID NO: 1836 - DNA, 10 bp, Artificial Sequence
  Description of Artificial Sequence: Synthetic oligonucleotide
  modified_base (2)..(2): a, c, t, g, unknown or other
tngagtragt

SEQ ID NO: 1837 - DNA, 10 bp, Artificial Sequence
  Description of Artificial Sequence: Synthetic oligonucleotide
  modified_base (1)..(1): a, c, t, g, unknown or other
nagagtragt

SEQ ID NO: 1838 - DNA, 10 bp, Artificial Sequence
  Description of Artificial Sequence: Synthetic oligonucleotide
  modified_base (1)..(1): a, c, t, g, unknown or other
ncgagtragt

SEQ ID NO: 1839 - DNA, 10 bp, Artificial Sequence
  Description of Artificial Sequence: Synthetic oligonucleotide
  modified_base (1)..(1): a, c, t, g, unknown or other
nggagtragt

SEQ ID NO: 1840 - DNA, 10 bp, Artificial Sequence
  Description of Artificial Sequence: Synthetic oligonucleotide
  modified_base (1)..(1): a, c, t, g, unknown or other
ntgagtragt

SEQ ID NO: 1841 - DNA, 10 bp, Artificial Sequence
  Description of Artificial Sequence: Synthetic oligonucleotide
aagagtragt

SEQ ID NO: 1842 - DNA, 10 bp, Artificial Sequence
  Description of Artificial Sequence: Synthetic oligonucleotide
acgagtragt

SEQ ID NO: 1843 - DNA, 10 bp, Artificial Sequence
  Description of Artificial Sequence: Synthetic oligonucleotide
aggagtragt

SEQ ID NO: 1844 - DNA, 10 bp, Artificial Sequence
  Description of Artificial Sequence: Synthetic oligonucleotide
atgagtragt

SEQ ID NO: 1845 - DNA, 10 bp, Artificial Sequence
  Description of Artificial Sequence: Synthetic oligonucleotide
cagagtragt

SEQ ID NO: 1846 - DNA, 10 bp, Artificial Sequence
  Description of Artificial Sequence: Synthetic oligonucleotide
ccgagtragt

SEQ ID NO: 1847 - DNA, 10 bp, Artificial Sequence
  Description of Artificial Sequence: Synthetic oligonucleotide
cggagtragt

SEQ ID NO: 1848 - DNA, 10 bp, Artificial Sequence
  Description of Artificial Sequence: Synthetic oligonucleotide
ctgagtragt

SEQ ID NO: 1849 - DNA, 10 bp, Artificial Sequence
  Description of Artificial Sequence: Synthetic oligonucleotide
gagagtragt

SEQ ID NO: 1850 - DNA, 10 bp, Artificial Sequence
  Description of Artificial Sequence: Synthetic oligonucleotide
gcgagtragt

SEQ ID NO: 1851 - DNA, 10 bp, Artificial Sequence
  Description of Artificial Sequence: Synthetic oligonucleotide
gggagtragt

SEQ ID NO: 1852 - DNA, 10 bp, Artificial Sequence
  Description of Artificial Sequence: Synthetic oligonucleotide
gtgagtragt

SEQ ID NO: 1853 - DNA, 10 bp, Artificial Sequence
  Description of Artificial Sequence: Synthetic oligonucleotide
tagagtragt

SEQ ID NO: 1854 - DNA, 10 bp, Artificial Sequence
  Description of Artificial Sequence: Synthetic oligonucleotide
tcgagtragt

SEQ ID NO: 1855 - DNA, 10 bp, Artificial Sequence
  Description of Artificial Sequence: Synthetic oligonucleotide
tggagtragt

SEQ ID NO: 1856 - DNA, 10 bp, Artificial Sequence
  Description of Artificial Sequence: Synthetic oligonucleotide
ttgagtragt

SEQ ID NO: 1857 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
angagtragn

SEQ ID NO: 1858 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
angagtrcgn

SEQ ID NO: 1859 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
angagtrggn

SEQ ID NO: 1860 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
angagtrtgn

SEQ ID NO: 1861 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
nagagtragn

SEQ ID NO: 1862 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
nagagtrcgn

SEQ ID NO: 1863 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
nagagtrggn

SEQ ID NO: 1864 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
nagagtrtgn

SEQ ID NO: 1865 - DNA, 10 bp, Artificial Sequence
  Description of Artificial Sequence: Synthetic oligonucleotide
  modified_base (10)..(10): a, c, t, g, unknown or other
aagagtragn

SEQ ID NO: 1866 - DNA, 10 bp, Artificial Sequence
  Description of Artificial Sequence: Synthetic oligonucleotide
  modified_base (10)..(10): a, c, t, g, unknown or other
aagagtrcgn

SEQ ID NO: 1867 - DNA, 10 bp, Artificial Sequence
  Description of Artificial Sequence: Synthetic oligonucleotide
  modified_base (10)..(10): a, c, t, g, unknown or other
aagagtrggn

SEQ ID NO: 1868 - DNA, 10 bp, Artificial Sequence
  Description of Artificial Sequence: Synthetic oligonucleotide
  modified_base (10)..(10): a, c, t, g, unknown or other
aagagtrtgn

SEQ ID NO: 1869 - DNA, 10 bp, Artificial Sequence
  Description of Artificial Sequence: Synthetic oligonucleotide
  modified_base (10)..(10): a, c, t, g, unknown or other
cagagtragn

SEQ ID NO: 1870 - DNA, 10 bp, Artificial Sequence
  Description of Artificial Sequence: Synthetic oligonucleotide
  modified_base (10)..(10): a, c, t, g, unknown or other
cagagtrcgn

SEQ ID NO: 1871 - DNA, 10 bp, Artificial Sequence
  Description of Artificial Sequence: Synthetic oligonucleotide
  modified_base (10)..(10): a, c, t, g, unknown or other
cagagtrggn

SEQ ID NO: 1872 - DNA, 10 bp, Artificial Sequence
  Description of Artificial Sequence: Synthetic oligonucleotide
  modified_base (10)..(10): a, c, t, g, unknown or other
cagagtrtgn

SEQ ID NO: 1873 - DNA, 10 bp, Artificial Sequence
  Description of Artificial Sequence: Synthetic oligonucleotide
  modified_base (10)..(10): a, c, t, g, unknown or other
gagagtragn

SEQ ID NO: 1874 - DNA, 10 bp, Artificial Sequence
  Description of Artificial Sequence: Synthetic oligonucleotide
  modified_base (10)..(10): a, c, t, g, unknown or other
gagagtrcgn

SEQ ID NO: 1875 - DNA, 10 bp, Artificial Sequence
  Description of Artificial Sequence: Synthetic oligonucleotide
  modified_base (10)..(10): a, c, t, g, unknown or other
gagagtrggn

SEQ ID NO: 1876 - DNA, 10 bp, Artificial Sequence
  Description of Artificial Sequence: Synthetic oligonucleotide
  modified_base (10)..(10): a, c, t, g, unknown or other
gagagtrtgn

SEQ ID NO: 1877 - DNA, 10 bp, Artificial Sequence
  Description of Artificial Sequence: Synthetic oligonucleotide
  modified_base (10)..(10): a, c, t, g, unknown or other
tagagtragn

SEQ ID NO: 1878 - DNA, 10 bp, Artificial Sequence
  Description of Artificial Sequence: Synthetic oligonucleotide
  modified_base (10)..(10): a, c, t, g, unknown or other
tagagtrcgn

SEQ ID NO: 1879 - DNA, 10 bp, Artificial Sequence
  Description of Artificial Sequence: Synthetic oligonucleotide
  modified_base (10)..(10): a, c, t, g, unknown or other
tagagtrggn

SEQ ID NO: 1880 - DNA, 10 bp, Artificial Sequence
  Description of Artificial Sequence: Synthetic oligonucleotide
  modified_base (10)..(10): a, c, t, g, unknown or other
tagagtrtgn

SEQ ID NO: 1881 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
cngagtragn

SEQ ID NO: 1882 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
cngagtrcgn

SEQ ID NO: 1883 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
cngagtrggn

SEQ ID NO: 1884 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
cngagtrtgn

SEQ ID NO: 1885 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
ncgagtragn

SEQ ID NO: 1886 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
ncgagtrcgn

SEQ ID NO: 1887 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
ncgagtrggn

SEQ ID NO: 1888 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
ncgagtrtgn

SEQ ID NO: 1889 - DNA, 10 bp, Artificial Sequence
  Description of Artificial Sequence: Synthetic oligonucleotide
  modified_base (10)..(10): a, c, t, g, unknown or other
acgagtragn

SEQ ID NO: 1890 - DNA, 10 bp, Artificial Sequence
  Description of Artificial Sequence: Synthetic oligonucleotide
  modified_base (10)..(10): a, c, t, g, unknown or other
acgagtrcgn

SEQ ID NO: 1891 - DNA, 10 bp, Artificial Sequence
  Description of Artificial Sequence: Synthetic oligonucleotide
  modified_base (10)..(10): a, c, t, g, unknown or other
acgagtrggn

SEQ ID NO: 1892 - DNA, 10 bp, Artificial Sequence
  Description of Artificial Sequence: Synthetic oligonucleotide
  modified_base (10)..(10): a, c, t, g, unknown or other
acgagtrtgn

SEQ ID NO: 1893 - DNA, 10 bp, Artificial Sequence
  Description of Artificial Sequence: Synthetic oligonucleotide
  modified_base (10)..(10): a, c, t, g, unknown or other
ccgagtragn

SEQ ID NO: 1894 - DNA, 10 bp, Artificial Sequence
  Description of Artificial Sequence: Synthetic oligonucleotide
  modified_base (10)..(10): a, c, t, g, unknown or other
ccgagtrcgn

SEQ ID NO: 1895 - DNA, 10 bp, Artificial Sequence
  Description of Artificial Sequence: Synthetic oligonucleotide
  modified_base (10)..(10): a, c, t, g, unknown or other
ccgagtrggn

SEQ ID NO: 1896 - DNA, 10 bp, Artificial Sequence
  Description of Artificial Sequence: Synthetic oligonucleotide
  modified_base (10)..(10): a, c, t, g, unknown or other
ccgagtrtgn

SEQ ID NO: 1897 - DNA, 10 bp, Artificial Sequence
  Description of Artificial Sequence: Synthetic oligonucleotide
  modified_base (10)..(10): a, c, t, g, unknown or other
gcgagtragn

SEQ ID NO: 1898 - DNA, 10 bp, Artificial Sequence
  Description of Artificial Sequence: Synthetic oligonucleotide
  modified_base (10)..(10): a, c, t, g, unknown or other
gcgagtrcgn

SEQ ID NO: 1899 - DNA, 10 bp, Artificial Sequence
  Description of Artificial Sequence: Synthetic oligonucleotide
  modified_base (10)..(10): a, c, t, g, unknown or other
gcgagtrggn

SEQ ID NO: 1900 - DNA, 10 bp, Artificial Sequence
  Description of Artificial Sequence: Synthetic oligonucleotide
  modified_base (10)..(10): a, c, t, g, unknown or other
gcgagtrtgn

SEQ ID NO: 1901 - DNA, 10 bp, Artificial Sequence
  Description of Artificial Sequence: Synthetic oligonucleotide
  modified_base (10)..(10): a, c, t, g, unknown or other
tcgagtragn

SEQ ID NO: 1902 - DNA, 10 bp, Artificial Sequence
  Description of Artificial Sequence: Synthetic oligonucleotide
  modified_base (10)..(10): a, c, t, g, unknown or other
tcgagtrcgn

SEQ ID NO: 1903 - DNA, 10 bp, Artificial Sequence
  Description of Artificial Sequence: Synthetic oligonucleotide
  modified_base (10)..(10): a, c, t, g, unknown or other
tcgagtrggn

SEQ ID NO: 1904 - DNA, 10 bp, Artificial Sequence
  Description of Artificial Sequence: Synthetic oligonucleotide
  modified_base (10)..(10): a, c, t, g, unknown or other
tcgagtrtgn

SEQ ID NO: 1905 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
gngagtragn

SEQ ID NO: 1906 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
gngagtrcgn

SEQ ID NO: 1907 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
gngagtrggn

SEQ ID NO: 1908 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
gngagtrtgn

SEQ ID NO: 1909 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
nggagtragn

SEQ ID NO: 1910 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
nggagtrcgn

SEQ ID NO: 1911 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
nggagtrggn

SEQ ID NO: 1912 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
nggagtrtgn

SEQ ID NO: 1913 - DNA, 10 bp, Artificial Sequence
  Description of Artificial Sequence: Synthetic oligonucleotide
  modified_base (10)..(10): a, c, t, g, unknown or other
aggagtragn

SEQ ID NO: 1914 - DNA, 10 bp, Artificial Sequence
  Description of Artificial Sequence: Synthetic oligonucleotide
  modified_base (10)..(10): a, c, t, g, unknown or other
aggagtrcgn

SEQ ID NO: 1915 - DNA, 10 bp, Artificial Sequence
  Description of Artificial Sequence: Synthetic oligonucleotide
  modified_base (10)..(10): a, c, t, g, unknown or other
aggagtrggn

SEQ ID NO: 1916 - DNA, 10 bp, Artificial Sequence
  Description of Artificial Sequence: Synthetic oligonucleotide
  modified_base (10)..(10): a, c, t, g, unknown or other
aggagtrtgn

SEQ ID NO: 1917 - DNA, 10 bp, Artificial Sequence
  Description of Artificial Sequence: Synthetic oligonucleotide
  modified_base (10)..(10): a, c, t, g, unknown or other
cggagtragn

SEQ ID NO: 1918 - DNA, 10 bp, Artificial Sequence
  Description of Artificial Sequence: Synthetic oligonucleotide
  modified_base (10)..(10): a, c, t, g, unknown or other
cggagtrcgn

SEQ ID NO: 1919 - DNA, 10 bp, Artificial Sequence
  Description of Artificial Sequence: Synthetic oligonucleotide
  modified_base (10)..(10): a, c, t, g, unknown or other
cggagtrggn

SEQ ID NO: 1920 - DNA, 10 bp, Artificial Sequence
  Description of Artificial Sequence: Synthetic oligonucleotide
  modified_base (10)..(10): a, c, t, g, unknown or other
cggagtrtgn

SEQ ID NO: 1921 - DNA, 10 bp, Artificial Sequence
  Description of Artificial Sequence: Synthetic oligonucleotide
  modified_base (10)..(10): a, c, t, g, unknown or other
gggagtragn

SEQ ID NO: 1922 - DNA, 10 bp, Artificial Sequence
  Description of Artificial Sequence: Synthetic oligonucleotide
  modified_base (10)..(10): a, c, t, g, unknown or other
gggagtrcgn

SEQ ID NO: 1923 - DNA, 10 bp, Artificial Sequence
  Description of Artificial Sequence: Synthetic oligonucleotide
  modified_base (10)..(10): a, c, t, g, unknown or other
gggagtrggn

SEQ ID NO: 1924 - DNA, 10 bp, Artificial Sequence
  Description of Artificial Sequence: Synthetic oligonucleotide
  modified_base (10)..(10): a, c, t, g, unknown or other
gggagtrtgn

SEQ ID NO: 1925 - DNA, 10 bp, Artificial Sequence
  Description of Artificial Sequence: Synthetic oligonucleotide
  modified_base (10)..(10): a, c, t, g, unknown or other
tggagtragn

SEQ ID NO: 1926 - DNA, 10 bp, Artificial Sequence
  Description of Artificial Sequence: Synthetic oligonucleotide
  modified_base (10)..(10): a, c, t, g, unknown or other
tggagtrcgn

SEQ ID NO: 1927 - DNA, 10 bp, Artificial Sequence
  Description of Artificial Sequence: Synthetic oligonucleotide
  modified_base (10)..(10): a, c, t, g, unknown or other
tggagtrggn

SEQ ID NO: 1928 - DNA, 10 bp, Artificial Sequence
  Description of Artificial Sequence: Synthetic oligonucleotide
  modified_base (10)..(10): a, c, t, g, unknown or other
tggagtrtgn

SEQ ID NO: 1929 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
tngagtragn

SEQ ID NO: 1930 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
tngagtrcgn

SEQ ID NO: 1931 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
tngagtrggn

SEQ ID NO: 1932 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
tngagtrtgn

SEQ ID NO: 1933 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
ntgagtragn

SEQ ID NO: 1934 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
ntgagtrcgn

SEQ ID NO: 1935 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
ntgagtrggn

SEQ ID NO: 1936 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
ntgagtrtgn

SEQ ID NO: 1937 - DNA, 10 bp, Artificial Sequence
  Description of Artificial Sequence: Synthetic oligonucleotide
  modified_base (10)..(10): a, c, t, g, unknown or other
atgagtragn

SEQ ID NO: 1938 - DNA, 10 bp, Artificial Sequence
  Description of Artificial Sequence: Synthetic oligonucleotide
  modified_base (10)..(10): a, c, t, g, unknown or other
atgagtrcgn

SEQ ID NO: 1939 - DNA, 10 bp, Artificial Sequence
  Description of Artificial Sequence: Synthetic oligonucleotide
  modified_base (10)..(10): a, c, t, g, unknown or other
atgagtrggn

SEQ ID NO: 1940 - DNA, 10 bp, Artificial Sequence
  Description of Artificial Sequence: Synthetic oligonucleotide
  modified_base (10)..(10): a, c, t, g, unknown or other
atgagtrtgn

SEQ ID NO: 1941 - DNA, 10 bp, Artificial Sequence
  Description of Artificial Sequence: Synthetic oligonucleotide
  modified_base (10)..(10): a, c, t, g, unknown or other
ctgagtragn

SEQ ID NO: 1942 - DNA, 10 bp, Artificial Sequence
  Description of Artificial Sequence: Synthetic oligonucleotide
  modified_base (10)..(10): a, c, t, g, unknown or other
ctgagtrcgn

SEQ ID NO: 1943 - DNA, 10 bp, Artificial Sequence
  Description of Artificial Sequence: Synthetic oligonucleotide
  modified_base (10)..(10): a, c, t, g, unknown or other
ctgagtrggn

SEQ ID NO: 1944 - DNA, 10 bp, Artificial Sequence
  Description of Artificial Sequence: Synthetic oligonucleotide
  modified_base (10)..(10): a, c, t, g, unknown or other
ctgagtrtgn

SEQ ID NO: 1945 - DNA, 10 bp, Artificial Sequence
  Description of Artificial Sequence: Synthetic oligonucleotide
  modified_base (10)..(10): a, c, t, g, unknown or other
gtgagtragn

SEQ ID NO: 1946 - DNA, 10 bp, Artificial Sequence
  Description of Artificial Sequence: Synthetic oligonucleotide
  modified_base (10)..(10): a, c, t, g, unknown or other
gtgagtrcgn

SEQ ID NO: 1947 - DNA, 10 bp, Artificial Sequence
  Description of Artificial Sequence: Synthetic oligonucleotide
  modified_base (10)..(10): a, c, t, g, unknown or other
gtgagtrggn

SEQ ID NO: 1948 - DNA, 10 bp, Artificial Sequence
  Description of Artificial Sequence: Synthetic oligonucleotide
  modified_base (10)..(10): a, c, t, g, unknown or other
gtgagtrtgn

SEQ ID NO: 1949 - DNA, 10 bp, Artificial Sequence
  Description of Artificial Sequence: Synthetic oligonucleotide
  modified_base (10)..(10): a, c, t, g, unknown or other
ttgagtragn

SEQ ID NO: 1950 - DNA, 10 bp, Artificial Sequence
  Description of Artificial Sequence: Synthetic oligonucleotide
  modified_base (10)..(10): a, c, t, g, unknown or other
ttgagtrcgn

SEQ ID NO: 1951 - DNA, 10 bp, Artificial Sequence
  Description of Artificial Sequence: Synthetic oligonucleotide
  modified_base (10)..(10): a, c, t, g, unknown or other
ttgagtrggn

SEQ ID NO: 1952 - DNA, 10 bp, Artificial Sequence
  Description of Artificial Sequence: Synthetic oligonucleotide
  modified_base (10)..(10): a, c, t, g, unknown or other
ttgagtrtgn

SEQ ID NO: 1953 - DNA, 10 bp, Artificial Sequence
  Description of Artificial Sequence: Synthetic oligonucleotide
  modified_base (2)..(2): a, c, t, g, unknown or other
angagtraga

SEQ ID NO: 1954 - DNA, 10 bp, Artificial Sequence
  Description of Artificial Sequence: Synthetic oligonucleotide
  modified_base (2)..(2): a, c, t, g, unknown or other
angagtrcga

SEQ ID NO: 1955 - DNA, 10 bp, Artificial Sequence
  Description of Artificial Sequence: Synthetic oligonucleotide
  modified_base (2)..(2): a, c, t, g, unknown or other
angagtrgga

SEQ ID NO: 1956 - DNA, 10 bp, Artificial Sequence
  Description of Artificial Sequence: Synthetic oligonucleotide
  modified_base (2)..(2): a, c, t, g, unknown or other
angagtrtga

SEQ ID NO: 1957 - DNA, 10 bp, Artificial Sequence
  Description of Artificial Sequence: Synthetic oligonucleotide
  modified_base (1)..(1): a, c, t, g, unknown or other
nagagtraga

SEQ ID NO: 1958 - DNA, 10 bp, Artificial Sequence
  Description of Artificial Sequence: Synthetic oligonucleotide
  modified_base (1)..(1): a, c, t, g, unknown or other
nagagtrcga

SEQ ID NO: 1959 - DNA, 10 bp, Artificial Sequence
  Description of Artificial Sequence: Synthetic oligonucleotide
  modified_base (1)..(1): a, c, t, g, unknown or other
nagagtrgga

SEQ ID NO: 1960 - DNA, 10 bp, Artificial Sequence
  Description of Artificial Sequence: Synthetic oligonucleotide
  modified_base (1)..(1): a, c, t, g, unknown or other
nagagtrtga

SEQ ID NO: 1961 - DNA, 10 bp, Artificial Sequence
  Description of Artificial Sequence: Synthetic oligonucleotide
aagagtraga

SEQ ID NO: 1962 - DNA, 10 bp, Artificial Sequence
  Description of Artificial Sequence: Synthetic oligonucleotide
aagagtrcga

SEQ ID NO: 1963 - DNA, 10 bp, Artificial Sequence
  Description of Artificial Sequence: Synthetic oligonucleotide
aagagtrgga

SEQ ID NO: 1964 - DNA, 10 bp, Artificial Sequence
  Description of Artificial Sequence: Synthetic oligonucleotide
aagagtrtga

SEQ ID NO: 1965 - DNA, 10 bp, Artificial Sequence
  Description of Artificial Sequence: Synthetic oligonucleotide
cagagtraga

SEQ ID NO: 1966 - DNA, 10 bp, Artificial Sequence
  Description of Artificial Sequence: Synthetic oligonucleotide
cagagtrcga

SEQ ID NO: 1967 - DNA, 10 bp, Artificial Sequence
  Description of Artificial Sequence: Synthetic oligonucleotide
cagagtrgga

SEQ ID NO: 1968 - DNA, 10 bp, Artificial Sequence
  Description of Artificial Sequence: Synthetic oligonucleotide
cagagtrtga

SEQ ID NO: 1969 - DNA, 10 bp, Artificial Sequence
  Description of Artificial Sequence: Synthetic oligonucleotide
gagagtraga

SEQ ID NO: 1970 - DNA, 10 bp, Artificial Sequence
  Description of Artificial Sequence: Synthetic oligonucleotide
gagagtrcga

SEQ ID NO: 1971 - DNA, 10 bp, Artificial Sequence
  Description of Artificial Sequence: Synthetic oligonucleotide
gagagtrgga

SEQ ID NO: 1972 - DNA, 10 bp, Artificial Sequence
  Description of Artificial Sequence: Synthetic oligonucleotide
gagagtrtga

SEQ ID NO: 1973 - DNA, 10 bp, Artificial Sequence
  Description of Artificial Sequence: Synthetic oligonucleotide
tagagtraga

SEQ ID NO: 1974 - DNA, 10 bp, Artificial Sequence
  Description of Artificial Sequence: Synthetic oligonucleotide
tagagtrcga

SEQ ID NO: 1975 - DNA, 10 bp, Artificial Sequence
  Description of Artificial Sequence: Synthetic oligonucleotide
tagagtrgga

SEQ ID NO: 1976 - DNA, 10 bp, Artificial Sequence
  Description of Artificial Sequence: Synthetic oligonucleotide
tagagtrtga

SEQ ID NO: 1977 - DNA, 10 bp, Artificial Sequence
  Description of Artificial Sequence: Synthetic oligonucleotide
  modified_base (2)..(2): a, c, t, g, unknown or other
cngagtraga

SEQ ID NO: 1978 - DNA, 10 bp, Artificial Sequence
  Description of Artificial Sequence: Synthetic oligonucleotide
  modified_base (2)..(2): a, c, t, g, unknown or other
cngagtrcga

SEQ ID NO: 1979 - DNA, 10 bp, Artificial Sequence
  Description of Artificial Sequence: Synthetic oligonucleotide
  modified_base (2)..(2): a, c, t, g, unknown or other
cngagtrgga

SEQ ID NO: 1980 - DNA, 10 bp, Artificial Sequence
  Description of Artificial Sequence: Synthetic oligonucleotide
  modified_base (2)..(2): a, c, t, g, unknown or other
cngagtrtga

SEQ ID NO: 1981 - DNA, 10 bp, Artificial Sequence
  Description of Artificial Sequence: Synthetic oligonucleotide
  modified_base (1)..(1): a, c, t, g, unknown or other
ncgagtraga

SEQ ID NO: 1982 - DNA, 10 bp, Artificial Sequence
  Description of Artificial Sequence: Synthetic oligonucleotide
  modified_base (1)..(1): a, c, t, g, unknown or other
ncgagtrcga

SEQ ID NO: 1983 - DNA, 10 bp, Artificial Sequence
  Description of Artificial Sequence: Synthetic oligonucleotide
  modified_base (1)..(1): a, c, t, g, unknown or other
ncgagtrgga

SEQ ID NO: 1984 - DNA, 10 bp, Artificial Sequence
  Description of Artificial Sequence: Synthetic oligonucleotide
  modified_base (1)..(1): a, c, t, g, unknown or other
ncgagtrtga

SEQ ID NO: 1985 - DNA, 10 bp, Artificial Sequence
  Description of Artificial Sequence: Synthetic oligonucleotide
acgagtraga

SEQ ID NO: 1986 - DNA, 10 bp, Artificial Sequence
  Description of Artificial Sequence: Synthetic oligonucleotide
acgagtrcga

SEQ ID NO: 1987 - DNA, 10 bp, Artificial Sequence
  Description of Artificial Sequence: Synthetic oligonucleotide
acgagtrgga

SEQ ID NO: 1988 - DNA, 10 bp, Artificial Sequence
  Description of Artificial Sequence: Synthetic oligonucleotide
acgagtrtga

SEQ ID NO: 1989 - DNA, 10 bp, Artificial Sequence
  Description of Artificial Sequence: Synthetic oligonucleotide
ccgagtraga

SEQ ID NO: 1990 - DNA, 10 bp, Artificial Sequence
  Description of Artificial Sequence: Synthetic oligonucleotide
ccgagtrcga

SEQ ID NO: 1991 - DNA, 10 bp, Artificial Sequence
  Description of Artificial Sequence: Synthetic oligonucleotide
ccgagtrgga

SEQ ID NO: 1992 - DNA, 10 bp, Artificial Sequence
  Description of Artificial Sequence: Synthetic oligonucleotide
ccgagtrtga

SEQ ID NO: 1993 - DNA, 10 bp, Artificial Sequence
  Description of Artificial Sequence: Synthetic oligonucleotide
gcgagtraga

SEQ ID NO: 1994 - DNA, 10 bp, Artificial Sequence
  Description of Artificial Sequence: Synthetic oligonucleotide
gcgagtrcga

SEQ ID NO: 1995 - DNA, 10 bp, Artificial Sequence
  Description of Artificial Sequence: Synthetic oligonucleotide
gcgagtrgga

SEQ ID NO: 1996 - DNA, 10 bp, Artificial Sequence
  Description of Artificial Sequence: Synthetic oligonucleotide
gcgagtrtga

SEQ ID NO: 1997 - DNA, 10 bp, Artificial Sequence
  Description of Artificial Sequence: Synthetic oligonucleotide
tcgagtraga

SEQ ID NO: 1998 - DNA, 10 bp, Artificial Sequence
  Description of Artificial Sequence: Synthetic oligonucleotide
tcgagtrcga

SEQ ID NO: 1999 - DNA, 10 bp, Artificial Sequence
  Description of Artificial Sequence: Synthetic oligonucleotide
tcgagtrgga

SEQ ID NO: 2000 - DNA, 10 bp, Artificial Sequence
  Description of Artificial Sequence: Synthetic oligonucleotide
tcgagtrtga

SEQ ID NO: 2001 - DNA, 10 bp, Artificial Sequence
  Description of Artificial Sequence: Synthetic oligonucleotide
  modified_base (2)..(2): a, c, t, g, unknown or other
gngagtraga

SEQ ID NO: 2002 - DNA, 10 bp, Artificial Sequence
  Description of Artificial Sequence: Synthetic oligonucleotide
  modified_base (2)..(2): a, c, t, g, unknown or other
gngagtrcga

SEQ ID NO: 2003 - DNA, 10 bp, Artificial Sequence
  Description of Artificial Sequence: Synthetic oligonucleotide
  modified_base (2)..(2): a, c, t, g, unknown or other
gngagtrgga

SEQ ID NO: 2004 - DNA, 10 bp, Artificial Sequence
  Description of Artificial Sequence: Synthetic oligonucleotide
  modified_base (2)..(2): a, c, t, g, unknown or other
gngagtrtga

SEQ ID NO: 2005 - DNA, 10 bp, Artificial Sequence
  Description of Artificial Sequence: Synthetic oligonucleotide
  modified_base (1)..(1): a, c, t, g, unknown or other
nggagtraga

SEQ ID NO: 2006 - DNA, 10 bp, Artificial Sequence
  Description of Artificial Sequence: Synthetic oligonucleotide
  modified_base (1)..(1): a, c, t, g, unknown or other
nggagtrcga

SEQ ID NO: 2007 - DNA, 10 bp, Artificial Sequence
  Description of Artificial Sequence: Synthetic oligonucleotide
  modified_base (1)..(1): a, c, t, g, unknown or other
nggagtrgga

SEQ ID NO: 2008 - DNA, 10 bp, Artificial Sequence
  Description of Artificial Sequence: Synthetic oligonucleotide
  modified_base (1)..(1): a, c, t, g, unknown or other
nggagtrtga

SEQ ID NO: 2009 - DNA, 10 bp, Artificial Sequence
  Description of Artificial Sequence: Synthetic oligonucleotide
aggagtraga

SEQ ID NO: 2010 - DNA, 10 bp, Artificial Sequence
  Description of Artificial Sequence: Synthetic oligonucleotide
aggagtrcga

SEQ ID NO: 2011 - DNA, 10 bp, Artificial Sequence
  Description of Artificial Sequence: Synthetic oligonucleotide
aggagtrgga

SEQ ID NO: 2012 - DNA, 10 bp, Artificial Sequence
  Description of Artificial Sequence: Synthetic oligonucleotide
aggagtrtga

SEQ ID NO: 2013 - DNA, 10 bp, Artificial Sequence
  Description of Artificial Sequence: Synthetic oligonucleotide
cggagtraga

SEQ ID NO: 2014 - DNA, 10 bp, Artificial Sequence
  Description of Artificial Sequence: Synthetic oligonucleotide
cggagtrcga

SEQ ID NO: 2015 - DNA, 10 bp, Artificial Sequence
  Description of Artificial Sequence: Synthetic oligonucleotide
cggagtrgga

SEQ ID NO: 2016 - DNA, 10 bp, Artificial Sequence
  Description of Artificial Sequence: Synthetic oligonucleotide
cggagtrtga

SEQ ID NO: 2017 - DNA, 10 bp, Artificial Sequence
  Description of Artificial Sequence: Synthetic oligonucleotide
gggagtraga

SEQ ID NO: 2018 - DNA, 10 bp, Artificial Sequence
  Description of Artificial Sequence: Synthetic oligonucleotide
gggagtrcga

SEQ ID NO: 2019 - DNA, 10 bp, Artificial Sequence
  Description of Artificial Sequence: Synthetic oligonucleotide
gggagtrgga

SEQ ID NO: 2020 - DNA, 10 bp, Artificial Sequence
  Description of Artificial Sequence: Synthetic oligonucleotide
gggagtrtga

SEQ ID NO: 2021 - DNA, 10 bp, Artificial Sequence
  Description of Artificial Sequence: Synthetic oligonucleotide
tggagtraga

SEQ ID NO: 2022 - DNA, 10 bp, Artificial Sequence
  Description of Artificial Sequence: Synthetic oligonucleotide
tggagtrcga

SEQ ID NO: 2023 - DNA, 10 bp, Artificial Sequence
  Description of Artificial Sequence: Synthetic oligonucleotide
tggagtrgga

SEQ ID NO: 2024 - DNA, 10 bp, Artificial Sequence
  Description of Artificial Sequence: Synthetic oligonucleotide
tggagtrtga

SEQ ID NO: 2025 - DNA, 10 bp, Artificial Sequence
  Description of Artificial Sequence: Synthetic oligonucleotide
  modified_base (2)..(2): a, c, t, g, unknown or other
tngagtraga

SEQ ID NO: 2026 - DNA, 10 bp, Artificial Sequence
  Description of Artificial Sequence: Synthetic oligonucleotide
  modified_base (2)..(2): a, c, t, g, unknown or other
tngagtrcga

SEQ ID NO: 2027 - DNA, 10 bp, Artificial Sequence
  Description of Artificial Sequence: Synthetic oligonucleotide
  modified_base (2)..(2): a, c, t, g, unknown or other
tngagtrgga

SEQ ID NO: 2028 - DNA, 10 bp, Artificial Sequence
  Description of Artificial Sequence: Synthetic oligonucleotide
  modified_base (2)..(2): a, c, t, g, unknown or other
tngagtrtga

SEQ ID NO: 2029 - DNA, 10 bp, Artificial Sequence
  Description of Artificial Sequence: Synthetic oligonucleotide
  modified_base (1)..(1): a, c, t, g, unknown or other
ntgagtraga

SEQ ID NO: 2030 - DNA, 10 bp, Artificial Sequence
  Description of Artificial Sequence: Synthetic oligonucleotide
  modified_base (1)..(1): a, c, t, g, unknown or other
ntgagtrcga

SEQ ID NO: 2031 - DNA, 10 bp, Artificial Sequence
  Description of Artificial Sequence: Synthetic oligonucleotide
  modified_base (1)..(1): a, c, t, g, unknown or other
ntgagtrgga

SEQ ID NO: 2032 - DNA, 10 bp, Artificial Sequence
  Description of Artificial Sequence: Synthetic oligonucleotide
  modified_base (1)..(1): a, c, t, g, unknown or other
ntgagtrtga

SEQ ID NO: 2033 - DNA, 10 bp, Artificial Sequence
  Description of Artificial Sequence: Synthetic oligonucleotide
atgagtraga

SEQ ID NO: 2034 - DNA, 10 bp, Artificial Sequence
  Description of Artificial Sequence: Synthetic oligonucleotide
atgagtrcga

SEQ ID NO: 2035 - DNA, 10 bp, Artificial Sequence
  Description of Artificial Sequence: Synthetic oligonucleotide
atgagtrgga

SEQ ID NO: 2036 - DNA, 10 bp, Artificial Sequence
  Description of Artificial Sequence: Synthetic oligonucleotide
atgagtrtga

SEQ ID NO: 2037 - DNA, 10 bp, Artificial Sequence
  Description of Artificial Sequence: Synthetic oligonucleotide
ctgagtraga

SEQ ID NO: 2038 - DNA, 10 bp, Artificial Sequence
  Description of Artificial Sequence: Synthetic oligonucleotide
ctgagtrcga

SEQ ID NO: 2039 - DNA, 10 bp, Artificial Sequence
  Description of Artificial Sequence: Synthetic oligonucleotide
ctgagtrgga

SEQ ID NO: 2040 - DNA, 10 bp, Artificial Sequence
  Description of Artificial Sequence: Synthetic oligonucleotide
ctgagtrtga

SEQ ID NO: 2041 - DNA, 10 bp, Artificial Sequence
  Description of Artificial Sequence: Synthetic oligonucleotide
gtgagtraga

SEQ ID NO: 2042 - DNA, 10 bp, Artificial Sequence
  Description of Artificial Sequence: Synthetic oligonucleotide
gtgagtrcga

SEQ ID NO: 2043 - DNA, 10 bp, Artificial Sequence
  Description of Artificial Sequence: Synthetic oligonucleotide
gtgagtrgga

SEQ ID NO: 2044 - DNA, 10 bp, Artificial Sequence
  Description of Artificial Sequence: Synthetic oligonucleotide
gtgagtrtga

SEQ ID NO: 2045 - DNA, 10 bp, Artificial Sequence
  Description of Artificial Sequence: Synthetic oligonucleotide
ttgagtraga

SEQ ID NO: 2046 - DNA, 10 bp, Artificial Sequence
  Description of Artificial Sequence: Synthetic oligonucleotide
ttgagtrcga

SEQ ID NO: 2047 - DNA, 10 bp, Artificial Sequence
  Description of Artificial Sequence: Synthetic oligonucleotide
ttgagtrgga

SEQ ID NO: 2048 - DNA, 10 bp, Artificial Sequence
  Description of Artificial Sequence: Synthetic oligonucleotide
ttgagtrtga

SEQ ID NO: 2049 - DNA, 10 bp, Artificial Sequence
  Description of Artificial Sequence: Synthetic oligonucleotide
  modified_base (2)..(2): a, c, t, g, unknown or other
angagtragc

SEQ ID NO: 2050 - DNA, 10 bp, Artificial Sequence
  Description of Artificial Sequence: Synthetic oligonucleotide
  modified_base (2)..(2): a, c, t, g, unknown or other
angagtrcgc

SEQ ID NO: 2051 - DNA, 10 bp, Artificial Sequence
  Description of Artificial Sequence: Synthetic oligonucleotide
  modified_base (2)..(2): a, c, t, g, unknown or other
angagtrggc

SEQ ID NO: 2052 - DNA, 10 bp, Artificial Sequence
  Description of Artificial Sequence: Synthetic oligonucleotide
  modified_base (2)..(2): a, c, t, g, unknown or other
angagtrtgc

SEQ ID NO: 2053 - DNA, 10 bp, Artificial Sequence
  Description of Artificial Sequence: Synthetic oligonucleotide
  modified_base (1)..(1): a, c, t, g, unknown or other
nagagtragc

SEQ ID NO: 2054 - DNA, 10 bp, Artificial Sequence
  Description of Artificial Sequence: Synthetic oligonucleotide
  modified_base (1)..(1): a, c, t, g, unknown or other
nagagtrcgc

SEQ ID NO: 2055 - DNA, 10 bp, Artificial Sequence
  Description of Artificial Sequence: Synthetic oligonucleotide
  modified_base (1)..(1): a, c, t, g, unknown or other
nagagtrggc

SEQ ID NO: 2056 - DNA, 10 bp, Artificial Sequence
  Description of Artificial Sequence: Synthetic oligonucleotide
  modified_base (1)..(1): a, c, t, g, unknown or other
nagagtrtgc

SEQ ID NO: 2057 - DNA, 10 bp, Artificial Sequence
  Description of Artificial Sequence: Synthetic oligonucleotide
aagagtragc

SEQ ID NO: 2058 - DNA, 10 bp, Artificial Sequence
  Description of Artificial Sequence: Synthetic oligonucleotide
aagagtrcgc

SEQ ID NO: 2059 - DNA, 10 bp, Artificial Sequence
  Description of Artificial Sequence: Synthetic oligonucleotide
aagagtrggc

SEQ ID NO: 2060 - DNA, 10 bp, Artificial Sequence
  Description of Artificial Sequence: Synthetic oligonucleotide
aagagtrtgc

SEQ ID NO: 2061 - DNA, 10 bp, Artificial Sequence
  Description of Artificial Sequence: Synthetic oligonucleotide
cagagtragc

SEQ ID NO: 2062 - DNA, 10 bp, Artificial Sequence
  Description of Artificial Sequence: Synthetic oligonucleotide
cagagtrcgc

SEQ ID NO: 2063 - DNA, 10 bp, Artificial Sequence
  Description of Artificial Sequence: Synthetic oligonucleotide
cagagtrggc

SEQ ID NO: 2064 - DNA, 10 bp, Artificial Sequence
  Description of Artificial Sequence: Synthetic oligonucleotide
cagagtrtgc

SEQ ID NO: 2065 - DNA, 10 bp, Artificial Sequence
  Description of Artificial Sequence: Synthetic oligonucleotide
gagagtragc

SEQ ID NO: 2066 - DNA, 10 bp, Artificial Sequence
  Description of Artificial Sequence: Synthetic oligonucleotide
gagagtrcgc

SEQ ID NO: 2067 - DNA, 10 bp, Artificial Sequence
  Description of Artificial Sequence: Synthetic oligonucleotide
gagagtrggc

SEQ ID NO: 2068 - DNA, 10 bp, Artificial Sequence
  Description of Artificial Sequence: Synthetic oligonucleotide
gagagtrtgc

SEQ ID NO: 2069 - DNA, 10 bp, Artificial Sequence
  Description of Artificial Sequence: Synthetic oligonucleotide
tagagtragc

SEQ ID NO: 2070 - DNA, 10 bp, Artificial Sequence
  Description of Artificial Sequence: Synthetic oligonucleotide
tagagtrcgc

SEQ ID NO: 2071 - DNA, 10 bp, Artificial Sequence
  Description of Artificial Sequence: Synthetic oligonucleotide
tagagtrggc

SEQ ID NO: 2072 - DNA, 10 bp, Artificial Sequence
  Description of Artificial Sequence: Synthetic oligonucleotide
tagagtrtgc

SEQ ID NO: 2073 - DNA, 10 bp, Artificial Sequence
  Description of Artificial Sequence: Synthetic oligonucleotide
  modified_base (2)..(2): a, c, t, g, unknown or other
cngagtragc

SEQ ID NO: 2074 - DNA, 10 bp, Artificial Sequence
  Description of Artificial Sequence: Synthetic oligonucleotide
  modified_base (2)..(2): a, c, t, g, unknown or other
cngagtrcgc

SEQ ID NO: 2075 - DNA, 10 bp, Artificial Sequence
  Description of Artificial Sequence: Synthetic oligonucleotide
  modified_base (2)..(2): a, c, t, g, unknown or other
cngagtrggc

SEQ ID NO: 2076 - DNA, 10 bp, Artificial Sequence
  Description of Artificial Sequence: Synthetic oligonucleotide
  modified_base (2)..(2): a, c, t, g, unknown or other
cngagtrtgc

SEQ ID NO: 2077 - DNA, 10 bp, Artificial Sequence
  Description of Artificial Sequence: Synthetic oligonucleotide
  modified_base (1)..(1): a, c, t, g, unknown or other
ncgagtragc

SEQ ID NO: 2078 - DNA, 10 bp, Artificial Sequence
  Description of Artificial Sequence: Synthetic oligonucleotide
  modified_base (1)..(1): a, c, t, g, unknown or other
ncgagtrcgc

SEQ ID NO: 2079 - DNA, 10 bp, Artificial Sequence
  Description of Artificial Sequence: Synthetic oligonucleotide
  modified_base (1)..(1): a, c, t, g, unknown or other
ncgagtrggc

SEQ ID NO: 2080 - DNA, 10 bp, Artificial Sequence
  Description of Artificial Sequence: Synthetic oligonucleotide
  modified_base (1)..(1): a, c, t, g, unknown or other
ncgagtrtgc

SEQ ID NO: 2081 - DNA, 10 bp, Artificial Sequence
  Description of Artificial Sequence: Synthetic oligonucleotide
acgagtragc

SEQ ID NO: 2082 - DNA, 10 bp, Artificial Sequence
  Description of Artificial Sequence: Synthetic oligonucleotide
acgagtrcgc

SEQ ID NO: 2083 - DNA, 10 bp, Artificial Sequence
  Description of Artificial Sequence: Synthetic oligonucleotide
acgagtrggc

SEQ ID NO: 2084 - DNA, 10 bp, Artificial Sequence
  Description of Artificial Sequence: Synthetic oligonucleotide
acgagtrtgc

SEQ ID NO: 2085 - DNA, 10 bp, Artificial Sequence
  Description of Artificial Sequence: Synthetic oligonucleotide
ccgagtragc

SEQ ID NO: 2086 - DNA, 10 bp, Artificial Sequence
  Description of Artificial Sequence: Synthetic oligonucleotide
ccgagtrcgc

SEQ ID NO: 2087 - DNA, 10 bp, Artificial Sequence
  Description of Artificial Sequence: Synthetic oligonucleotide
ccgagtrggc

SEQ ID NO: 2088 - DNA, 10 bp, Artificial Sequence
  Description of Artificial Sequence: Synthetic oligonucleotide
ccgagtrtgc

SEQ ID NO: 2089 - DNA, 10 bp, Artificial Sequence
  Description of Artificial Sequence: Synthetic oligonucleotide
gcgagtragc

SEQ ID NO: 2090 - DNA, 10 bp, Artificial Sequence
  Description of Artificial Sequence: Synthetic oligonucleotide
gcgagtrcgc

SEQ ID NO: 2091 - DNA, 10 bp, Artificial Sequence
  Description of Artificial Sequence: Synthetic oligonucleotide
gcgagtrggc

SEQ ID NO: 2092 - DNA, 10 bp, Artificial Sequence
  Description of Artificial Sequence: Synthetic oligonucleotide
gcgagtrtgc

SEQ ID NO: 2093 - DNA, 10 bp, Artificial Sequence
  Description of Artificial Sequence: Synthetic oligonucleotide
tcgagtragc

SEQ ID NO: 2094 - DNA, 10 bp, Artificial Sequence
  Description of Artificial Sequence: Synthetic oligonucleotide
tcgagtrcgc

SEQ ID NO: 2095 - DNA, 10 bp, Artificial Sequence
  Description of Artificial Sequence: Synthetic oligonucleotide
tcgagtrggc

SEQ ID NO: 2096 - DNA, 10 bp, Artificial Sequence
  Description of Artificial Sequence: Synthetic oligonucleotide
tcgagtrtgc

SEQ ID NO: 2097 - DNA, 10 bp, Artificial Sequence
  Description of Artificial Sequence: Synthetic oligonucleotide
  modified_base (2)..(2): a, c, t, g, unknown or other
gngagtragc

SEQ ID NO: 2098 - DNA, 10 bp, Artificial Sequence
  Description of Artificial Sequence: Synthetic oligonucleotide
  modified_base (2)..(2): a, c, t, g, unknown or other
gngagtrcgc

SEQ ID NO: 2099 - DNA, 10 bp, Artificial Sequence
  Description of Artificial Sequence: Synthetic oligonucleotide
  modified_base (2)..(2): a, c, t, g, unknown or other
gngagtrggc

SEQ ID NO: 2100 - DNA, 10 bp, Artificial Sequence
  Description of Artificial Sequence: Synthetic oligonucleotide
  modified_base (2)..(2): a, c, t, g, unknown or other
gngagtrtgc

SEQ ID NO: 2101 - DNA, 10 bp, Artificial Sequence
  Description of Artificial Sequence: Synthetic oligonucleotide
  modified_base (1)..(1): a, c, t, g, unknown or other
nggagtragc

SEQ ID NO: 2102 - DNA, 10 bp, Artificial Sequence
  Description of Artificial Sequence: Synthetic oligonucleotide
  modified_base (1)..(1): a, c, t, g, unknown or other
nggagtrcgc

SEQ ID NO: 2103 - DNA, 10 bp, Artificial Sequence
  Description of Artificial Sequence: Synthetic oligonucleotide
  modified_base (1)..(1): a, c, t, g, unknown or other
nggagtrggc

SEQ ID NO: 2104 - DNA, 10 bp, Artificial Sequence
  Description of Artificial Sequence: Synthetic oligonucleotide
  modified_base (1)..(1): a, c, t, g, unknown or other
nggagtrtgc

SEQ ID NO: 2105 - DNA, 10 bp, Artificial Sequence
  Description of Artificial Sequence: Synthetic oligonucleotide
aggagtragc

SEQ ID NO: 2106 - DNA, 10 bp, Artificial Sequence
  Description of Artificial Sequence: Synthetic oligonucleotide
aggagtrcgc

SEQ ID NO: 2107 - DNA, 10 bp, Artificial Sequence
  Description of Artificial Sequence: Synthetic oligonucleotide
aggagtrggc

SEQ ID NO: 2108 - DNA, 10 bp, Artificial Sequence
  Description of Artificial Sequence: Synthetic oligonucleotide
aggagtrtgc

SEQ ID NO: 2109 - DNA, 10 bp, Artificial Sequence
  Description of Artificial Sequence: Synthetic oligonucleotide
cggagtragc

SEQ ID NO: 2110 - DNA, 10 bp, Artificial Sequence
  Description of Artificial Sequence: Synthetic oligonucleotide
cggagtrcgc

SEQ ID NO: 2111 - DNA, 10 bp, Artificial Sequence
  Description of Artificial Sequence: Synthetic oligonucleotide
cggagtrggc

SEQ ID NO: 2112 - DNA, 10 bp, Artificial Sequence
  Description of Artificial Sequence: Synthetic oligonucleotide
cggagtrtgc

SEQ ID NO: 2113 - DNA, 10 bp, Artificial Sequence
  Description of Artificial Sequence: Synthetic oligonucleotide
gggagtragc

SEQ ID NO: 2114 - DNA, 10 bp, Artificial Sequence
  Description of Artificial Sequence: Synthetic oligonucleotide
gggagtrcgc

SEQ ID NO: 2115 - DNA, 10 bp, Artificial Sequence
  Description of Artificial Sequence: Synthetic oligonucleotide
gggagtrggc

SEQ ID NO: 2116 - DNA, 10 bp, Artificial Sequence
  Description of Artificial Sequence: Synthetic oligonucleotide
gggagtrtgc

SEQ ID NO: 2117 - DNA, 10 bp, Artificial Sequence
  Description of Artificial Sequence: Synthetic oligonucleotide
tggagtragc

SEQ ID NO: 2118 - DNA, 10 bp, Artificial Sequence
  Description of Artificial Sequence: Synthetic oligonucleotide
tggagtrcgc

SEQ ID NO: 2119 - DNA, 10 bp, Artificial Sequence
  Description of Artificial Sequence: Synthetic oligonucleotide
tggagtrggc

SEQ ID NO: 2120 - DNA, 10 bp, Artificial Sequence
  Description of Artificial Sequence: Synthetic oligonucleotide
tggagtrtgc

SEQ ID NO: 2121 - DNA, 10 bp, Artificial Sequence
  Description of Artificial Sequence: Synthetic oligonucleotide
  modified_base (2)..(2): a, c, t, g, unknown or other
tngagtragc

SEQ ID NO: 2122 - DNA, 10 bp, Artificial Sequence
  Description of Artificial Sequence: Synthetic oligonucleotide
  modified_base (2)..(2): a, c, t, g, unknown or other
tngagtrcgc

SEQ ID NO: 2123 - DNA, 10 bp, Artificial Sequence
  Description of Artificial Sequence: Synthetic oligonucleotide
  modified_base (2)..(2): a, c, t, g, unknown or other
tngagtrggc

SEQ ID NO: 2124 - DNA, 10 bp, Artificial Sequence
  Description of Artificial Sequence: Synthetic oligonucleotide
  modified_base (2)..(2): a, c, t, g, unknown or other
tngagtrtgc

SEQ ID NO: 2125 - DNA, 10 bp, Artificial Sequence
  Description of Artificial Sequence: Synthetic oligonucleotide
  modified_base (1)..(1): a, c, t, g, unknown or other
ntgagtragc

SEQ ID NO: 2126 - DNA, 10 bp, Artificial Sequence
  Description of Artificial Sequence: Synthetic oligonucleotide
  modified_base (1)..(1): a, c, t, g, unknown or other
ntgagtrcgc

SEQ ID NO: 2127 - DNA, 10 bp, Artificial Sequence
  Description of Artificial Sequence: Synthetic oligonucleotide
  modified_base (1)..(1): a, c, t, g, unknown or other
ntgagtrggc

SEQ ID NO: 2128 - DNA, 10 bp, Artificial Sequence
  Description of Artificial Sequence: Synthetic oligonucleotide
  modified_base (1)..(1): a, c, t, g, unknown or other
ntgagtrtgc

SEQ ID NO: 2129 - DNA, 10 bp, Artificial Sequence
  Description of Artificial Sequence: Synthetic oligonucleotide
atgagtragc

SEQ ID NO: 2130 - DNA, 10 bp, Artificial Sequence
  Description of Artificial Sequence: Synthetic oligonucleotide
atgagtrcgc

SEQ ID NO: 2131 - DNA, 10 bp, Artificial Sequence
  Description of Artificial Sequence: Synthetic oligonucleotide
atgagtrggc

SEQ ID NO: 2132 - DNA, 10 bp, Artificial Sequence
  Description of Artificial Sequence: Synthetic oligonucleotide
atgagtrtgc

SEQ ID NO: 2133 - DNA, 10 bp, Artificial Sequence
  Description of Artificial Sequence: Synthetic oligonucleotide
ctgagtragc

SEQ ID NO: 2134 - DNA, 10 bp, Artificial Sequence
  Description of Artificial Sequence: Synthetic oligonucleotide
ctgagtrcgc

SEQ ID NO: 2135 - DNA, 10 bp, Artificial Sequence
  Description of Artificial Sequence: Synthetic oligonucleotide
ctgagtrggc

SEQ ID NO: 2136 - DNA, 10 bp, Artificial Sequence
  Description of Artificial Sequence: Synthetic oligonucleotide
ctgagtrtgc

SEQ ID NO: 2137 - DNA, 10 bp, Artificial Sequence
  Description of Artificial Sequence: Synthetic oligonucleotide
gtgagtragc

SEQ ID NO: 2138 - DNA, 10 bp, Artificial Sequence
  Description of Artificial Sequence: Synthetic oligonucleotide
gtgagtrcgc

SEQ ID NO: 2139 - DNA, 10 bp, Artificial Sequence
  Description of Artificial Sequence: Synthetic oligonucleotide
gtgagtrggc

SEQ ID NO: 2140 - DNA, 10 bp, Artificial Sequence
  Description of Artificial Sequence: Synthetic oligonucleotide
gtgagtrtgc

SEQ ID NO: 2141 - DNA, 10 bp, Artificial Sequence
  Description of Artificial Sequence: Synthetic oligonucleotide
ttgagtragc

SEQ ID NO: 2142 - DNA, 10 bp, Artificial Sequence
  Description of Artificial Sequence: Synthetic oligonucleotide
ttgagtrcgc

SEQ ID NO: 2143 - DNA, 10 bp, Artificial Sequence
  Description of Artificial Sequence: Synthetic oligonucleotide
ttgagtrggc

SEQ ID NO: 2144 - DNA, 10 bp, Artificial Sequence
  Description of Artificial Sequence: Synthetic oligonucleotide
ttgagtrtgc

SEQ ID NO: 2145 - DNA, 10 bp, Artificial Sequence
  Description of Artificial Sequence: Synthetic oligonucleotide
  modified_base (2)..(2): a, c, t, g, unknown or other
angagtragg

SEQ ID NO: 2146 - DNA, 10 bp, Artificial Sequence
  Description of Artificial Sequence: Synthetic oligonucleotide
  modified_base (2)..(2): a, c, t, g, unknown or other
angagtrcgg

SEQ ID NO: 2147 - DNA, 10 bp, Artificial Sequence
  Description of Artificial Sequence: Synthetic oligonucleotide
  modified_base (2)..(2): a, c, t, g, unknown or other
angagtrggg

SEQ ID NO: 2148 - DNA, 10 bp, Artificial Sequence
  Description of Artificial Sequence: Synthetic oligonucleotide
  modified_base (2)..(2): a, c, t, g, unknown or other
angagtrtgg

SEQ ID NO: 2149 - DNA, 10 bp, Artificial Sequence
  Description of Artificial Sequence: Synthetic oligonucleotide
  modified_base (1)..(1): a, c, t, g, unknown or other
nagagtragg

SEQ ID NO: 2150 - DNA, 10 bp, Artificial Sequence
  Description of Artificial Sequence: Synthetic oligonucleotide
  modified_base (1)..(1): a, c, t, g, unknown or other
nagagtrcgg

SEQ ID NO: 2151 - DNA, 10 bp, Artificial Sequence
  Description of Artificial Sequence: Synthetic oligonucleotide
  modified_base (1)..(1): a, c, t, g, unknown or other
nagagtrggg

SEQ ID NO: 2152 - DNA, 10 bp, Artificial Sequence
  Description of Artificial Sequence: Synthetic oligonucleotide
  modified_base (1)..(1): a, c, t, g, unknown or other
nagagtrtgg

SEQ ID NO: 2153 - DNA, 10 bp, Artificial Sequence
  Description of Artificial Sequence: Synthetic oligonucleotide
aagagtragg

SEQ ID NO: 2154 - DNA, 10 bp, Artificial Sequence
  Description of Artificial Sequence: Synthetic oligonucleotide
aagagtrcgg

SEQ ID NO: 2155 - DNA, 10 bp, Artificial Sequence
  Description of Artificial Sequence: Synthetic oligonucleotide
aagagtrggg

SEQ ID NO: 2156 - DNA, 10 bp, Artificial Sequence
  Description of Artificial Sequence: Synthetic oligonucleotide
aagagtrtgg

SEQ ID NO: 2157 - DNA, 10 bp, Artificial Sequence
  Description of Artificial Sequence: Synthetic oligonucleotide
cagagtragg

SEQ ID NO: 2158 - DNA, 10 bp, Artificial Sequence
  Description of Artificial Sequence: Synthetic oligonucleotide
cagagtrcgg

SEQ ID NO: 2159 - DNA, 10 bp, Artificial Sequence
  Description of Artificial Sequence: Synthetic oligonucleotide
cagagtrggg

SEQ ID NO: 2160 - DNA, 10 bp, Artificial Sequence
  Description of Artificial Sequence: Synthetic oligonucleotide
cagagtrtgg

SEQ ID NO: 2161 - DNA, 10 bp, Artificial Sequence
  Description of Artificial Sequence: Synthetic oligonucleotide
gagagtragg

SEQ ID NO: 2162 - DNA, 10 bp, Artificial Sequence
  Description of Artificial Sequence: Synthetic oligonucleotide
gagagtrcgg

SEQ ID NO: 2163 - DNA, 10 bp, Artificial Sequence
  Description of Artificial Sequence: Synthetic oligonucleotide
gagagtrggg

SEQ ID NO: 2164 - DNA, 10 bp, Artificial Sequence
  Description of Artificial Sequence: Synthetic oligonucleotide
gagagtrtgg

SEQ ID NO: 2165 - DNA, 10 bp, Artificial Sequence
  Description of Artificial Sequence: Synthetic oligonucleotide
tagagtragg

SEQ ID NO: 2166 - DNA, 10 bp, Artificial Sequence
  Description of Artificial Sequence: Synthetic oligonucleotide
tagagtrcgg

SEQ ID NO: 2167 - DNA, 10 bp, Artificial Sequence
  Description of Artificial Sequence: Synthetic oligonucleotide
tagagtrggg

SEQ ID NO: 2168 - DNA, 10 bp, Artificial Sequence
  Description of Artificial Sequence: Synthetic oligonucleotide
tagagtrtgg

SEQ ID NO: 2169 - DNA, 10 bp, Artificial Sequence
  Description of Artificial Sequence: Synthetic oligonucleotide
  modified_base (2)..(2): a, c, t, g, unknown or other
cngagtragg

SEQ ID NO: 2170 - DNA, 10 bp, Artificial Sequence
  Description of Artificial Sequence: Synthetic oligonucleotide
  modified_base (2)..(2): a, c, t, g, unknown or other
cngagtrcgg

SEQ ID NO: 2171 - DNA, 10 bp, Artificial Sequence
  Description of Artificial Sequence: Synthetic oligonucleotide
  modified_base (2)..(2): a, c, t, g, unknown or other
cngagtrggg

SEQ ID NO: 2172 - DNA, 10 bp, Artificial Sequence
  Description of Artificial Sequence: Synthetic oligonucleotide
  modified_base (2)..(2): a, c, t, g, unknown or other
cngagtrtgg

SEQ ID NO: 2173 - DNA, 10 bp, Artificial Sequence
  Description of Artificial Sequence: Synthetic oligonucleotide
  modified_base (1)..(1): a, c, t, g, unknown or other
ncgagtragg

SEQ ID NO: 2174 - DNA, 10 bp, Artificial Sequence
  Description of Artificial Sequence: Synthetic oligonucleotide
  modified_base (1)..(1): a, c, t, g, unknown or other
ncgagtrcgg

SEQ ID NO: 2175 - DNA, 10 bp, Artificial Sequence
  Description of Artificial Sequence: Synthetic oligonucleotide
  modified_base (1)..(1): a, c, t, g, unknown or other
ncgagtrggg

SEQ ID NO: 2176 - DNA, 10 bp, Artificial Sequence
  Description of Artificial Sequence: Synthetic oligonucleotide
  modified_base (1)..(1): a, c, t, g, unknown or other
ncgagtrtgg

SEQ ID NO: 2177 - DNA, 10 bp, Artificial Sequence
  Description of Artificial Sequence: Synthetic oligonucleotide
acgagtragg

SEQ ID NO: 2178 - DNA, 10 bp, Artificial Sequence
  Description of Artificial Sequence: Synthetic oligonucleotide
acgagtrcgg

SEQ ID NO: 2179 - DNA, 10 bp, Artificial Sequence
  Description of Artificial Sequence: Synthetic oligonucleotide
acgagtrggg

SEQ ID NO: 2180 - DNA, 10 bp, Artificial Sequence
  Description of Artificial Sequence: Synthetic oligonucleotide
acgagtrtgg

SEQ ID NO: 2181 - DNA, 10 bp, Artificial Sequence
  Description of Artificial Sequence: Synthetic oligonucleotide
ccgagtragg

SEQ ID NO: 2182 - DNA, 10 bp, Artificial Sequence
  Description of Artificial Sequence: Synthetic oligonucleotide
ccgagtrcgg

SEQ ID NO: 2183 - DNA, 10 bp, Artificial Sequence
  Description of Artificial Sequence: Synthetic oligonucleotide
ccgagtrggg

SEQ ID NO: 2184 - DNA, 10 bp, Artificial Sequence
  Description of Artificial Sequence: Synthetic oligonucleotide
ccgagtrtgg

SEQ ID NO: 2185 - DNA, 10 bp, Artificial Sequence
  Description of Artificial Sequence: Synthetic oligonucleotide
gcgagtragg

SEQ ID NO: 2186 - DNA, 10 bp, Artificial Sequence
  Description of Artificial Sequence: Synthetic oligonucleotide
gcgagtrcgg

SEQ ID NO: 2187 - DNA, 10 bp, Artificial Sequence
  Description of Artificial Sequence: Synthetic oligonucleotide
gcgagtrggg

SEQ ID NO: 2188 - DNA, 10 bp, Artificial Sequence
  Description of Artificial Sequence: Synthetic oligonucleotide
gcgagtrtgg

SEQ ID NO: 2189 - DNA, 10 bp, Artificial Sequence
  Description of Artificial Sequence: Synthetic oligonucleotide
tcgagtragg

SEQ ID NO: 2190 - DNA, 10 bp, Artificial Sequence
  Description of Artificial Sequence: Synthetic oligonucleotide
tcgagtrcgg

SEQ ID NO: 2191 - DNA, 10 bp, Artificial Sequence
  Description of Artificial Sequence: Synthetic oligonucleotide
tcgagtrggg

SEQ ID NO: 2192 - DNA, 10 bp, Artificial Sequence
  Description of Artificial Sequence: Synthetic oligonucleotide
tcgagtrtgg

SEQ ID NO: 2193 - DNA, 10 bp, Artificial Sequence
  Description of Artificial Sequence: Synthetic oligonucleotide
  modified_base (2)..(2): a, c, t, g, unknown or other
gngagtragg

SEQ ID NO: 2194 - DNA, 10 bp, Artificial Sequence
  Description of Artificial Sequence: Synthetic oligonucleotide
  modified_base (2)..(2): a, c, t, g, unknown or other
gngagtrcgg

SEQ ID NO: 2195 - DNA, 10 bp, Artificial Sequence
  Description of Artificial Sequence: Synthetic oligonucleotide
  modified_base (2)..(2): a, c, t, g, unknown or other
gngagtrggg

SEQ ID NO: 2196 - DNA, 10 bp, Artificial Sequence
  Description of Artificial Sequence: Synthetic oligonucleotide
  modified_base (2)..(2): a, c, t, g, unknown or other
gngagtrtgg

SEQ ID NO: 2197 - DNA, 10 bp, Artificial Sequence
  Description of Artificial Sequence: Synthetic oligonucleotide
  modified_base (1)..(1): a, c, t, g, unknown or other
nggagtragg

SEQ ID NO: 2198 - DNA, 10 bp, Artificial Sequence
  Description of Artificial Sequence: Synthetic oligonucleotide
  modified_base (1)..(1): a, c, t, g, unknown or other
nggagtrcgg

SEQ ID NO: 2199 - DNA, 10 bp, Artificial Sequence
  Description of Artificial Sequence: Synthetic oligonucleotide
  modified_base (1)..(1): a, c, t, g, unknown or other
nggagtrggg

SEQ ID NO: 2200 - DNA, 10 bp, Artificial Sequence
  Description of Artificial Sequence: Synthetic oligonucleotide
  modified_base (1)..(1): a, c, t, g, unknown or other
nggagtrtgg

SEQ ID NO: 2201 - DNA, 10 bp, Artificial Sequence
  Description of Artificial Sequence: Synthetic oligonucleotide
aggagtragg

SEQ ID NO: 2202 - DNA, 10 bp, Artificial Sequence
  Description of Artificial Sequence: Synthetic oligonucleotide
aggagtrcgg

SEQ ID NO: 2203 - DNA, 10 bp, Artificial Sequence
  Description of Artificial Sequence: Synthetic oligonucleotide
aggagtrggg

SEQ ID NO: 2204 - DNA, 10 bp, Artificial Sequence
  Description of Artificial Sequence: Synthetic oligonucleotide
aggagtrtgg

SEQ ID NO: 2205 - DNA, 10 bp, Artificial Sequence
  Description of Artificial Sequence: Synthetic oligonucleotide
cggagtragg

SEQ ID NO: 2206 - DNA, 10 bp, Artificial Sequence
  Description of Artificial Sequence: Synthetic oligonucleotide
cggagtrcgg

SEQ ID NO: 2207 - DNA, 10 bp, Artificial Sequence
  Description of Artificial Sequence: Synthetic oligonucleotide
cggagtrggg

SEQ ID NO: 2208 - DNA, 10 bp, Artificial Sequence
  Description of Artificial Sequence: Synthetic oligonucleotide
cggagtrtgg

SEQ ID NO: 2209 - DNA, 10 bp, Artificial Sequence
  Description of Artificial Sequence: Synthetic oligonucleotide
gggagtragg

SEQ ID NO: 2210 - DNA, 10 bp, Artificial Sequence
  Description of Artificial Sequence: Synthetic oligonucleotide
gggagtrcgg

SEQ ID NO: 2211 - DNA, 10 bp, Artificial Sequence
  Description of Artificial Sequence: Synthetic oligonucleotide
gggagtrggg

SEQ ID NO: 2212 - DNA, 10 bp, Artificial Sequence
  Description of Artificial Sequence: Synthetic oligonucleotide
gggagtrtgg

SEQ ID NO: 2213 - DNA, 10 bp, Artificial Sequence
  Description of Artificial Sequence: Synthetic oligonucleotide
tggagtragg

SEQ ID NO: 2214 - DNA, 10 bp, Artificial Sequence
  Description of Artificial Sequence: Synthetic oligonucleotide
tggagtrcgg

SEQ ID NO: 2215 - DNA, 10 bp, Artificial Sequence
  Description of Artificial Sequence: Synthetic oligonucleotide
tggagtrggg

SEQ ID NO: 2216 - DNA, 10 bp, Artificial Sequence
  Description of Artificial Sequence: Synthetic oligonucleotide
tggagtrtgg

SEQ ID NO: 2217 - DNA, 10 bp, Artificial Sequence
  Description of Artificial Sequence: Synthetic oligonucleotide
  modified_base (2)..(2): a, c, t, g, unknown or other
tngagtragg

SEQ ID NO: 2218 - DNA, 10 bp, Artificial Sequence
  Description of Artificial Sequence: Synthetic oligonucleotide
  modified_base (2)..(2): a, c, t, g, unknown or other
tngagtrcgg

SEQ ID NO: 2219 - DNA, 10 bp, Artificial Sequence
  Description of Artificial Sequence: Synthetic oligonucleotide
  modified_base (2)..(2): a, c, t, g, unknown or other
tngagtrggg

SEQ ID NO: 2220 - DNA, 10 bp, Artificial Sequence
  Description of Artificial Sequence: Synthetic oligonucleotide
  modified_base (2)..(2): a, c, t, g, unknown or other
tngagtrtgg

SEQ ID NO: 2221 - DNA, 10 bp, Artificial Sequence
  Description of Artificial Sequence: Synthetic oligonucleotide
  modified_base (1)..(1): a, c, t, g, unknown or other
ntgagtragg

SEQ ID NO: 2222 - DNA, 10 bp, Artificial Sequence
  Description of Artificial Sequence: Synthetic oligonucleotide
  modified_base (1)..(1): a, c, t, g, unknown or other
ntgagtrcgg

SEQ ID NO: 2223 - DNA, 10 bp, Artificial Sequence
  Description of Artificial Sequence: Synthetic oligonucleotide
  modified_base (1)..(1): a, c, t, g, unknown or other
ntgagtrggg

SEQ ID NO: 2224 - DNA, 10 bp, Artificial Sequence
  Description of Artificial Sequence: Synthetic oligonucleotide
  modified_base (1)..(1): a, c, t, g, unknown or other
ntgagtrtgg

SEQ ID NO: 2225 - DNA, 10 bp, Artificial Sequence
  Description of Artificial Sequence: Synthetic oligonucleotide
atgagtragg

SEQ ID NO: 2226 - DNA, 10 bp, Artificial Sequence
  Description of Artificial Sequence: Synthetic oligonucleotide
atgagtrcgg

SEQ ID NO: 2227 - DNA, 10 bp, Artificial Sequence
  Description of Artificial Sequence: Synthetic oligonucleotide
atgagtrggg

SEQ ID NO: 2228 - DNA, 10 bp, Artificial Sequence
  Description of Artificial Sequence: Synthetic oligonucleotide
atgagtrtgg

SEQ ID NO: 2229 - DNA, 10 bp, Artificial Sequence
  Description of Artificial Sequence: Synthetic oligonucleotide
ctgagtragg

SEQ ID NO: 2230 - DNA, 10 bp, Artificial Sequence
  Description of Artificial Sequence: Synthetic oligonucleotide
ctgagtrcgg

SEQ ID NO: 2231 - DNA, 10 bp, Artificial Sequence
  Description of Artificial Sequence: Synthetic oligonucleotide
ctgagtrggg

SEQ ID NO: 2232 - DNA, 10 bp, Artificial Sequence
  Description of Artificial Sequence: Synthetic oligonucleotide
ctgagtrtgg

SEQ ID NO: 2233 - DNA, 10 bp, Artificial Sequence
  Description of Artificial Sequence: Synthetic oligonucleotide
gtgagtragg

SEQ ID NO: 2234 - DNA, 10 bp, Artificial Sequence
  Description of Artificial Sequence: Synthetic oligonucleotide
gtgagtrcgg

SEQ ID NO: 2235 - DNA, 10 bp, Artificial Sequence
  Description of Artificial Sequence: Synthetic oligonucleotide
gtgagtrggg

SEQ ID NO: 2236 - DNA, 10 bp, Artificial Sequence
  Description of Artificial Sequence: Synthetic oligonucleotide
gtgagtrtgg

SEQ ID NO: 2237 - DNA, 10 bp, Artificial Sequence
  Description of Artificial Sequence: Synthetic oligonucleotide
ttgagtragg

SEQ ID NO: 2238 - DNA, 10 bp, Artificial Sequence
  Description of Artificial Sequence: Synthetic oligonucleotide
ttgagtrcgg

SEQ ID NO: 2239 - DNA, 10 bp, Artificial Sequence
  Description of Artificial Sequence: Synthetic oligonucleotide
ttgagtrggg

SEQ ID NO: 2240 - DNA, 10 bp, Artificial Sequence
  Description of Artificial Sequence: Synthetic oligonucleotide
ttgagtrtgg

SEQ ID NO: 2241 - DNA, 10 bp, Artificial Sequence
  Description of Artificial Sequence: Synthetic oligonucleotide
  modified_base (2)..(2): a, c, t, g, unknown or other
angagtrcgt

SEQ ID NO: 2242 - DNA, 10 bp, Artificial Sequence
  Description of Artificial Sequence: Synthetic oligonucleotide
  modified_base (2)..(2): a, c, t, g, unknown or other
angagtrggt

SEQ ID NO: 2243 - DNA, 10 bp, Artificial Sequence
  Description of Artificial Sequence: Synthetic oligonucleotide
  modified_base (2)..(2): a, c, t, g, unknown or other
angagtrtgt

SEQ ID NO: 2244 - DNA, 10 bp, Artificial Sequence
  Description of Artificial Sequence: Synthetic oligonucleotide
  modified_base (1)..(1): a, c, t, g, unknown or other
nagagtrcgt

SEQ ID NO: 2245 - DNA, 10 bp, Artificial Sequence
  Description of Artificial Sequence: Synthetic oligonucleotide
  modified_base (1)..(1): a, c, t, g, unknown or other
nagagtrggt

SEQ ID NO: 2246 - DNA, 10 bp, Artificial Sequence
  Description of Artificial Sequence: Synthetic oligonucleotide
  modified_base (1)..(1): a, c, t, g, unknown or other
nagagtrtgt

SEQ ID NO: 2247 - DNA, 10 bp, Artificial Sequence
  Description of Artificial Sequence: Synthetic oligonucleotide
aagagtrcgt

SEQ ID NO: 2248 - DNA, 10 bp, Artificial Sequence
  Description of Artificial Sequence: Synthetic oligonucleotide
aagagtrggt

SEQ ID NO: 2249 - DNA, 10 bp, Artificial Sequence
  Description of Artificial Sequence: Synthetic oligonucleotide
aagagtrtgt

SEQ ID NO: 2250 - DNA, 10 bp, Artificial Sequence
  Description of Artificial Sequence: Synthetic oligonucleotide
cagagtrcgt

SEQ ID NO: 2251 - DNA, 10 bp, Artificial Sequence
  Description of Artificial Sequence: Synthetic oligonucleotide
cagagtrggt

SEQ ID NO: 2252 - DNA, 10 bp, Artificial Sequence
  Description of Artificial Sequence: Synthetic oligonucleotide
cagagtrtgt

SEQ ID NO: 2253 - DNA, 10 bp, Artificial Sequence
  Description of Artificial Sequence: Synthetic oligonucleotide
gagagtrcgt

SEQ ID NO: 2254 - DNA, 10 bp, Artificial Sequence
  Description of Artificial Sequence: Synthetic oligonucleotide
gagagtrggt

SEQ ID NO: 2255 - DNA, 10 bp, Artificial Sequence
  Description of Artificial Sequence: Synthetic oligonucleotide
gagagtrtgt

SEQ ID NO: 2256 - DNA, 10 bp, Artificial Sequence
  Description of Artificial Sequence: Synthetic oligonucleotide
tagagtrcgt

SEQ ID NO: 2257 - DNA, 10 bp, Artificial Sequence
  Description of Artificial Sequence: Synthetic oligonucleotide
tagagtrggt

SEQ ID NO: 2258 - DNA, 10 bp, Artificial Sequence
  Description of Artificial Sequence: Synthetic oligonucleotide
tagagtrtgt

SEQ ID NO: 2259 - DNA, 10 bp, Artificial Sequence
  Description of Artificial Sequence: Synthetic oligonucleotide
  modified_base (2)..(2): a, c, t, g, unknown or other
cngagtrcgt

SEQ ID NO: 2260 - DNA, 10 bp, Artificial Sequence
  Description of Artificial Sequence: Synthetic oligonucleotide
  modified_base (2)..(2): a, c, t, g, unknown or other
cngagtrggt

SEQ ID NO: 2261 - DNA, 10 bp, Artificial Sequence
  Description of Artificial Sequence: Synthetic oligonucleotide
  modified_base (2)..(2): a, c, t, g, unknown or other
cngagtrtgt

SEQ ID NO: 2262 - DNA, 10 bp, Artificial Sequence
  Description of Artificial Sequence: Synthetic oligonucleotide
  modified_base (1)..(1): a, c, t, g, unknown or other
ncgagtrcgt

SEQ ID NO: 2263 - DNA, 10 bp, Artificial Sequence
  Description of Artificial Sequence: Synthetic oligonucleotide
  modified_base (1)..(1): a, c, t, g, unknown or other
ncgagtrggt

SEQ ID NO: 2264 - DNA, 10 bp, Artificial Sequence
  Description of Artificial Sequence: Synthetic oligonucleotide
  modified_base (1)..(1): a, c, t, g, unknown or other
ncgagtrtgt

SEQ ID NO: 2265 - DNA, 10 bp, Artificial Sequence
  Description of Artificial Sequence: Synthetic oligonucleotide
acgagtrcgt

SEQ ID NO: 2266 - DNA, 10 bp, Artificial Sequence
  Description of Artificial Sequence: Synthetic oligonucleotide
acgagtrggt

SEQ ID NO: 2267 - DNA, 10 bp, Artificial Sequence
  Description of Artificial Sequence: Synthetic oligonucleotide
acgagtrtgt

SEQ ID NO: 2268 - DNA, 10 bp, Artificial Sequence
  Description of Artificial Sequence: Synthetic oligonucleotide
ccgagtrcgt

SEQ ID NO: 2269 - DNA, 10 bp, Artificial Sequence
  Description of Artificial Sequence: Synthetic oligonucleotide
ccgagtrggt

SEQ ID NO: 2270 - DNA, 10 bp, Artificial Sequence
  Description of Artificial Sequence: Synthetic oligonucleotide
ccgagtrtgt

SEQ ID NO: 2271 - DNA, 10 bp, Artificial Sequence
  Description of Artificial Sequence: Synthetic oligonucleotide
gcgagtrcgt

SEQ ID NO: 2272 - DNA, 10 bp, Artificial Sequence
  Description of Artificial Sequence: Synthetic oligonucleotide
gcgagtrggt

SEQ ID NO: 2273 - DNA, 10 bp, Artificial Sequence
  Description of Artificial Sequence: Synthetic oligonucleotide
gcgagtrtgt

SEQ ID NO: 2274 - DNA, 10 bp, Artificial Sequence
  Description of Artificial Sequence: Synthetic oligonucleotide
tcgagtrcgt

SEQ ID NO: 2275 - DNA, 10 bp, Artificial Sequence
  Description of Artificial Sequence: Synthetic oligonucleotide
tcgagtrggt

SEQ ID NO: 2276 - DNA, 10 bp, Artificial Sequence
  Description of Artificial Sequence: Synthetic oligonucleotide
tcgagtrtgt

SEQ ID NO: 2277 - DNA, 10 bp, Artificial Sequence
  Description of Artificial Sequence: Synthetic oligonucleotide
  modified_base (2)..(2): a, c, t, g, unknown or other
gngagtrcgt

SEQ ID NO: 2278 - DNA, 10 bp, Artificial Sequence
  Description of Artificial Sequence: Synthetic oligonucleotide
  modified_base (2)..(2): a, c, t, g, unknown or other
gngagtrggt

SEQ ID NO: 2279 - DNA, 10 bp, Artificial Sequence
  Description of Artificial Sequence: Synthetic oligonucleotide
  modified_base (2)..(2): a, c, t, g, unknown or other
gngagtrtgt

SEQ ID NO: 2280 - DNA, 10 bp, Artificial Sequence
  Description of Artificial Sequence: Synthetic oligonucleotide
  modified_base (1)..(1): a, c, t, g, unknown or other
nggagtrcgt

SEQ ID NO: 2281 - DNA, 10 bp, Artificial Sequence
  Description of Artificial Sequence: Synthetic oligonucleotide
  modified_base (1)..(1): a, c, t, g, unknown or other
nggagtrggt

SEQ ID NO: 2282 - DNA, 10 bp, Artificial Sequence
  Description of Artificial Sequence: Synthetic oligonucleotide
  modified_base (1)..(1): a, c, t, g, unknown or other
nggagtrtgt

SEQ ID NO: 2283 - DNA, 10 bp, Artificial Sequence
  Description of Artificial Sequence: Synthetic oligonucleotide
aggagtrcgt

SEQ ID NO: 2284 - DNA, 10 bp, Artificial Sequence
  Description of Artificial Sequence: Synthetic oligonucleotide
aggagtrggt

SEQ ID NO: 2285 - DNA, 10 bp, Artificial Sequence
  Description of Artificial Sequence: Synthetic oligonucleotide
aggagtrtgt

SEQ ID NO: 2286 - DNA, 10 bp, Artificial Sequence
  Description of Artificial Sequence: Synthetic oligonucleotide
cggagtrcgt

SEQ ID NO: 2287 - DNA, 10 bp, Artificial Sequence
  Description of Artificial Sequence: Synthetic oligonucleotide
cggagtrggt

SEQ ID NO: 2288 - DNA, 10 bp, Artificial Sequence
  Description of Artificial Sequence: Synthetic oligonucleotide
cggagtrtgt

SEQ ID NO: 2289 - DNA, 10 bp, Artificial Sequence
  Description of Artificial Sequence: Synthetic oligonucleotide
gggagtrcgt

SEQ ID NO: 2290 - DNA, 10 bp, Artificial Sequence
  Description of Artificial Sequence: Synthetic oligonucleotide
gggagtrggt

SEQ ID NO: 2291 - DNA, 10 bp, Artificial Sequence
  Description of Artificial Sequence: Synthetic oligonucleotide
gggagtrtgt

SEQ ID NO: 2292 - DNA, 10 bp, Artificial Sequence
  Description of Artificial Sequence: Synthetic oligonucleotide
tggagtrcgt

SEQ ID NO: 2293 - DNA, 10 bp, Artificial Sequence
  Description of Artificial Sequence: Synthetic oligonucleotide
tggagtrggt

SEQ ID NO: 2294 - DNA, 10 bp, Artificial Sequence
  Description of Artificial Sequence: Synthetic oligonucleotide
tggagtrtgt

SEQ ID NO: 2295 - DNA, 10 bp, Artificial Sequence
  Description of Artificial Sequence: Synthetic oligonucleotide
  modified_base (2)..(2): a, c, t, g, unknown or other
tngagtrcgt

SEQ ID NO: 2296 - DNA, 10 bp, Artificial Sequence
  Description of Artificial Sequence: Synthetic oligonucleotide
  modified_base (2)..(2): a, c, t, g, unknown or other
tngagtrggt

SEQ ID NO: 2297 - DNA, 10 bp, Artificial Sequence
  Description of Artificial Sequence: Synthetic oligonucleotide
  modified_base (2)..(2): a, c, t, g, unknown or other
tngagtrtgt

SEQ ID NO: 2298 - DNA, 10 bp, Artificial Sequence
  Description of Artificial Sequence: Synthetic oligonucleotide
  modified_base (1)..(1): a, c, t, g, unknown or other
ntgagtrcgt

SEQ ID NO: 2299 - DNA, 10 bp, Artificial Sequence
  Description of Artificial Sequence: Synthetic oligonucleotide
  modified_base (1)..(1): a, c, t, g, unknown or other
ntgagtrggt

SEQ ID NO: 2300 - DNA, 10 bp, Artificial Sequence
  Description of Artificial Sequence: Synthetic oligonucleotide
  modified_base (1)..(1): a, c, t, g, unknown or other
ntgagtrtgt

SEQ ID NO: 2301 - DNA, 10 bp, Artificial Sequence
  Description of Artificial Sequence: Synthetic oligonucleotide
atgagtrcgt

SEQ ID NO: 2302 - DNA, 10 bp, Artificial Sequence
  Description of Artificial Sequence: Synthetic oligonucleotide
atgagtrggt

SEQ ID NO: 2303 - DNA, 10 bp, Artificial Sequence
  Description of Artificial Sequence: Synthetic oligonucleotide
atgagtrtgt

SEQ ID NO: 2304 - DNA, 10 bp, Artificial Sequence
  Description of Artificial Sequence: Synthetic oligonucleotide
ctgagtrcgt

SEQ ID NO: 2305 - DNA, 10 bp, Artificial Sequence
  Description of Artificial Sequence: Synthetic oligonucleotide
ctgagtrggt

SEQ ID NO: 2306 - DNA, 10 bp, Artificial Sequence
  Description of Artificial Sequence: Synthetic oligonucleotide
ctgagtrtgt

SEQ ID NO: 2307 - DNA, 10 bp, Artificial Sequence
  Description of Artificial Sequence: Synthetic oligonucleotide
gtgagtrcgt

SEQ ID NO: 2308 - DNA, 10 bp, Artificial Sequence
  Description of Artificial Sequence: Synthetic oligonucleotide
gtgagtrggt

SEQ ID NO: 2309 - DNA, 10 bp, Artificial Sequence
  Description of Artificial Sequence: Synthetic oligonucleotide
gtgagtrtgt

SEQ ID NO: 2310 - DNA, 10 bp, Artificial Sequence
  Description of Artificial Sequence: Synthetic oligonucleotide
ttgagtrcgt

SEQ ID NO: 2311 - DNA, 10 bp, Artificial Sequence
  Description of Artificial Sequence: Synthetic oligonucleotide
ttgagtrggt

SEQ ID NO: 2312 - DNA, 10 bp, Artificial Sequence
  Description of Artificial Sequence: Synthetic oligonucleotide
ttgagtrtgt

SEQ ID NO: 2313 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
angagtrnga

SEQ ID NO: 2314 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
angagtrngc

SEQ ID NO: 2315 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
angagtrngg

SEQ ID NO: 2316 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
angagtrngt

SEQ ID NO: 2317 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
nagagtrnga

SEQ ID NO: 2318 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
nagagtrngc

SEQ ID NO: 2319 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
nagagtrngg

SEQ ID NO: 2320 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
nagagtrngt

SEQ ID NO: 2321 - DNA, 10 bp, Artificial Sequence
  Description of Artificial Sequence: Synthetic oligonucleotide
  modified_base (8)..(8): a, c, t, g, unknown or other
aagagtrnga

SEQ ID NO: 2322 - DNA, 10 bp, Artificial Sequence
  Description of Artificial Sequence: Synthetic oligonucleotide
  modified_base (8)..(8): a, c, t, g, unknown or other
aagagtrngc

SEQ ID NO: 2323 - DNA, 10 bp, Artificial Sequence
  Description of Artificial Sequence: Synthetic oligonucleotide
  modified_base (8)..(8): a, c, t, g, unknown or other
aagagtrngg

SEQ ID NO: 2324 - DNA, 10 bp, Artificial Sequence
  Description of Artificial Sequence: Synthetic oligonucleotide
  modified_base (8)..(8): a, c, t, g, unknown or other
aagagtrngt

SEQ ID NO: 2325 - DNA, 10 bp, Artificial Sequence
  Description of Artificial Sequence: Synthetic oligonucleotide
  modified_base (8)..(8): a, c, t, g, unknown or other
cagagtrnga

SEQ ID NO: 2326 - DNA, 10 bp, Artificial Sequence
  Description of Artificial Sequence: Synthetic oligonucleotide
  modified_base (8)..(8): a, c, t, g, unknown or other
cagagtrngc

SEQ ID NO: 2327 - DNA, 10 bp, Artificial Sequence
  Description of Artificial Sequence: Synthetic oligonucleotide
  modified_base (8)..(8): a, c, t, g, unknown or other
cagagtrngg

SEQ ID NO: 2328 - DNA, 10 bp, Artificial Sequence
  Description of Artificial Sequence: Synthetic oligonucleotide
  modified_base (8)..(8): a, c, t, g, unknown or other
cagagtrngt

SEQ ID NO: 2329 - DNA, 10 bp, Artificial Sequence
  Description of Artificial Sequence: Synthetic oligonucleotide
  modified_base (8)..(8): a, c, t, g, unknown or other
gagagtrnga

SEQ ID NO: 2330 - DNA, 10 bp, Artificial Sequence
  Description of Artificial Sequence: Synthetic oligonucleotide
  modified_base (8)..(8): a, c, t, g, unknown or other
gagagtrngc

SEQ ID NO: 2331 - DNA, 10 bp, Artificial Sequence
  Description of Artificial Sequence: Synthetic oligonucleotide
  modified_base (8)..(8): a, c, t, g, unknown or other
gagagtrngg

SEQ ID NO: 2332 - DNA, 10 bp, Artificial Sequence
  Description of Artificial Sequence: Synthetic oligonucleotide
  modified_base (8)..(8): a, c, t, g, unknown or other
gagagtrngt

SEQ ID NO: 2333 - DNA, 10 bp, Artificial Sequence
  Description of Artificial Sequence: Synthetic oligonucleotide
  modified_base (8)..(8): a, c, t, g, unknown or other
tagagtrnga

SEQ ID NO: 2334 - DNA, 10 bp, Artificial Sequence
  Description of Artificial Sequence: Synthetic oligonucleotide
  modified_base (8)..(8): a, c, t, g, unknown or other
tagagtrngc

SEQ ID NO: 2335 - DNA, 10 bp, Artificial Sequence
  Description of Artificial Sequence: Synthetic oligonucleotide
  modified_base (8)..(8): a, c, t, g, unknown or other
tagagtrngg

SEQ ID NO: 2336 - DNA, 10 bp, Artificial Sequence
  Description of Artificial Sequence: Synthetic oligonucleotide
  modified_base (8)..(8): a, c, t, g, unknown or other
tagagtrngt

SEQ ID NO: 2337 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
cngagtrnga

SEQ ID NO: 2338 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
cngagtrngc

SEQ ID NO: 2339 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
cngagtrngg

SEQ ID NO: 2340 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
cngagtrngt

SEQ ID NO: 2341 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
ncgagtrnga

SEQ ID NO: 2342 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
ncgagtrngc

SEQ ID NO: 2343 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
ncgagtrngg

SEQ ID NO: 2344 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
ncgagtrngt

SEQ ID NO: 2345 - DNA, 10 bp, Artificial Sequence
  Description of Artificial Sequence: Synthetic oligonucleotide
  modified_base (8)..(8): a, c, t, g, unknown or other
acgagtrnga

SEQ ID NO: 2346 - DNA, 10 bp, Artificial Sequence
  Description of Artificial Sequence: Synthetic oligonucleotide
  modified_base (8)..(8): a, c, t, g, unknown or other
acgagtrngc

SEQ ID NO: 2347 - DNA, 10 bp, Artificial Sequence
  Description of Artificial Sequence: Synthetic oligonucleotide
  modified_base (8)..(8): a, c, t, g, unknown or other
acgagtrngg

SEQ ID NO: 2348 - DNA, 10 bp, Artificial Sequence
  Description of Artificial Sequence: Synthetic oligonucleotide
  modified_base (8)..(8): a, c, t, g, unknown or other
acgagtrngt

SEQ ID NO: 2349 - DNA, 10 bp, Artificial Sequence
  Description of Artificial Sequence: Synthetic oligonucleotide
  modified_base (8)..(8): a, c, t, g, unknown or other
ccgagtrnga

SEQ ID NO: 2350 - DNA, 10 bp, Artificial Sequence
  Description of Artificial Sequence: Synthetic oligonucleotide
  modified_base (8)..(8): a, c, t, g, unknown or other
ccgagtrngc

SEQ ID NO: 2351 - DNA, 10 bp, Artificial Sequence
  Description of Artificial Sequence: Synthetic oligonucleotide
  modified_base (8)..(8): a, c, t, g, unknown or other
ccgagtrngg

SEQ ID NO: 2352 - DNA, 10 bp, Artificial Sequence
  Description of Artificial Sequence: Synthetic oligonucleotide
  modified_base (8)..(8): a, c, t, g, unknown or other
ccgagtrngt

SEQ ID NO: 2353 - DNA, 10 bp, Artificial Sequence
  Description of Artificial Sequence: Synthetic oligonucleotide
  modified_base (8)..(8): a, c, t, g, unknown or other
gcgagtrnga

SEQ ID NO: 2354 - DNA, 10 bp, Artificial Sequence
  Description of Artificial Sequence: Synthetic oligonucleotide
  modified_base (8)..(8): a, c, t, g, unknown or other
gcgagtrngc

SEQ ID NO: 2355 - DNA, 10 bp, Artificial Sequence
  Description of Artificial Sequence: Synthetic oligonucleotide
  modified_base (8)..(8): a, c, t, g, unknown or other
gcgagtrngg

SEQ ID NO: 2356 - DNA, 10 bp, Artificial Sequence
  Description of Artificial Sequence: Synthetic oligonucleotide
  modified_base (8)..(8): a, c, t, g, unknown or other
gcgagtrngt

SEQ ID NO: 2357 - DNA, 10 bp, Artificial Sequence
  Description of Artificial Sequence: Synthetic oligonucleotide
  modified_base (8)..(8): a, c, t, g, unknown or other
tcgagtrnga

SEQ ID NO: 2358 - DNA, 10 bp, Artificial Sequence
  Description of Artificial Sequence: Synthetic oligonucleotide
  modified_base (8)..(8): a, c, t, g, unknown or other
tcgagtrngc

SEQ ID NO: 2359 - DNA, 10 bp, Artificial Sequence
  Description of Artificial Sequence: Synthetic oligonucleotide
  modified_base (8)..(8): a, c, t, g, unknown or other
tcgagtrngg

SEQ ID NO: 2360 - DNA, 10 bp, Artificial Sequence
  Description of Artificial Sequence: Synthetic oligonucleotide
  modified_base (8)..(8): a, c, t, g, unknown or other
tcgagtrngt

SEQ ID NO: 2361 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
gngagtrnga

SEQ ID NO: 2362 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
gngagtrngc

SEQ ID NO: 2363 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
gngagtrngg

SEQ ID NO: 2364 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
gngagtrngt

SEQ ID NO: 2365 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
nggagtrnga

SEQ ID NO: 2366 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
nggagtrngc

SEQ ID NO: 2367 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
nggagtrngg

SEQ ID NO: 2368 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
nggagtrngt

SEQ ID NO: 2369 - DNA, 10 bp, Artificial Sequence
  Description of Artificial Sequence: Synthetic oligonucleotide
  modified_base (8)..(8): a, c, t, g, unknown or other
aggagtrnga

SEQ ID NO: 2370 - DNA, 10 bp, Artificial Sequence
  Description of Artificial Sequence: Synthetic oligonucleotide
  modified_base (8)..(8): a, c, t, g, unknown or other
aggagtrngc

SEQ ID NO: 2371 - DNA, 10 bp, Artificial Sequence
  Description of Artificial Sequence: Synthetic oligonucleotide
  modified_base (8)..(8): a, c, t, g, unknown or other
aggagtrngg

SEQ ID NO: 2372 - DNA, 10 bp, Artificial Sequence
  Description of Artificial Sequence: Synthetic oligonucleotide
  modified_base (8)..(8): a, c, t, g, unknown or other
aggagtrngt

SEQ ID NO: 2373 - DNA, 10 bp, Artificial Sequence
  Description of Artificial Sequence: Synthetic oligonucleotide
  modified_base (8)..(8): a, c, t, g, unknown or other
cggagtrnga

SEQ ID NO: 2374 - DNA, 10 bp, Artificial Sequence
  Description of Artificial Sequence: Synthetic oligonucleotide
  modified_base (8)..(8): a, c, t, g, unknown or other
cggagtrngc

SEQ ID NO: 2375 - DNA, 10 bp, Artificial Sequence
  Description of Artificial Sequence: Synthetic oligonucleotide
  modified_base (8)..(8): a, c, t, g, unknown or other
cggagtrngg

SEQ ID NO: 2376 - DNA, 10 bp, Artificial Sequence
  Description of Artificial Sequence: Synthetic oligonucleotide
  modified_base (8)..(8): a, c, t, g, unknown or other
cggagtrngt

SEQ ID NO: 2377 - DNA, 10 bp, Artificial Sequence
  Description of Artificial Sequence: Synthetic oligonucleotide
  modified_base (8)..(8): a, c, t, g, unknown or other
gggagtrnga

SEQ ID NO: 2378 - DNA, 10 bp, Artificial Sequence
  Description of Artificial Sequence: Synthetic oligonucleotide
  modified_base (8)..(8): a, c, t, g, unknown or other
gggagtrngc

SEQ ID NO: 2379 - DNA, 10 bp, Artificial Sequence
  Description of Artificial Sequence: Synthetic oligonucleotide
  modified_base (8)..(8): a, c, t, g, unknown or other
gggagtrngg

SEQ ID NO: 2380 - DNA, 10 bp, Artificial Sequence
  Description of Artificial Sequence: Synthetic oligonucleotide
  modified_base (8)..(8): a, c, t, g, unknown or other
gggagtrngt

SEQ ID NO: 2381 - DNA, 10 bp, Artificial Sequence
  Description of Artificial Sequence: Synthetic oligonucleotide
  modified_base (8)..(8): a, c, t, g, unknown or other
tggagtrnga

SEQ ID NO: 2382 - DNA, 10 bp, Artificial Sequence
  Description of Artificial Sequence: Synthetic oligonucleotide
  modified_base (8)..(8): a, c, t, g, unknown or other
tggagtrngc

SEQ ID NO: 2383 - DNA, 10 bp, Artificial Sequence
  Description of Artificial Sequence: Synthetic oligonucleotide
  modified_base (8)..(8): a, c, t, g, unknown or other
tggagtrngg

SEQ ID NO: 2384 - DNA, 10 bp, Artificial Sequence
  Description of Artificial Sequence: Synthetic oligonucleotide
  modified_base (8)..(8): a, c, t, g, unknown or other
tggagtrngt

SEQ ID NO: 2385 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
tngagtrnga

SEQ ID NO: 2386 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
tngagtrngc

SEQ ID NO: 2387 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
tngagtrngg

SEQ ID NO: 2388 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
tngagtrngt

SEQ ID NO: 2389 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
ntgagtrnga

SEQ ID NO: 2390 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
ntgagtrngc

SEQ ID NO: 2391 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
ntgagtrngg

SEQ ID NO: 2392 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
ntgagtrngt

SEQ ID NO: 2393 - DNA, 10 bp, Artificial Sequence
  Description of Artificial Sequence: Synthetic oligonucleotide
  modified_base (8)..(8): a, c, t, g, unknown or other
atgagtrnga

SEQ ID NO: 2394 - DNA, 10 bp, Artificial Sequence
  Description of Artificial Sequence: Synthetic oligonucleotide
  modified_base (8)..(8): a, c, t, g, unknown or other
atgagtrngc

SEQ ID NO: 2395 - DNA, 10 bp, Artificial Sequence
  Description of Artificial Sequence: Synthetic oligonucleotide
  modified_base (8)..(8): a, c, t, g, unknown or other
atgagtrngg

SEQ ID NO: 2396 - DNA, 10 bp, Artificial Sequence
  Description of Artificial Sequence: Synthetic oligonucleotide
  modified_base (8)..(8): a, c, t, g, unknown or other
atgagtrngt

SEQ ID NO: 2397 - DNA, 10 bp, Artificial Sequence
  Description of Artificial Sequence: Synthetic oligonucleotide
  modified_base (8)..(8): a, c, t, g, unknown or other
ctgagtrnga

SEQ ID NO: 2398 - DNA, 10 bp, Artificial Sequence
  Description of Artificial Sequence: Synthetic oligonucleotide
  modified_base (8)..(8): a, c, t, g, unknown or other
ctgagtrngc

SEQ ID NO: 2399 - DNA, 10 bp, Artificial Sequence
  Description of Artificial Sequence: Synthetic oligonucleotide
  modified_base (8)..(8): a, c, t, g, unknown or other
ctgagtrngg

SEQ ID NO: 2400 - DNA, 10 bp, Artificial Sequence
  Description of Artificial Sequence: Synthetic oligonucleotide
  modified_base (8)..(8): a, c, t, g, unknown or other
ctgagtrngt

SEQ ID NO: 2401 - DNA, 10 bp, Artificial Sequence
  Description of Artificial Sequence: Synthetic oligonucleotide
  modified_base (8)..(8): a, c, t, g, unknown or other
gtgagtrnga

SEQ ID NO: 2402 - DNA, 10 bp, Artificial Sequence
  Description of Artificial Sequence: Synthetic oligonucleotide
  modified_base (8)..(8): a, c, t, g, unknown or other
gtgagtrngc

SEQ ID NO: 2403 - DNA, 10 bp, Artificial Sequence
  Description of Artificial Sequence: Synthetic oligonucleotide
  modified_base (8)..(8): a, c, t, g, unknown or other
gtgagtrngg

SEQ ID NO: 2404 - DNA, 10 bp, Artificial Sequence
  Description of Artificial Sequence: Synthetic oligonucleotide
  modified_base (8)..(8): a, c, t, g, unknown or other
gtgagtrngt

SEQ ID NO: 2405 - DNA, 10 bp, Artificial Sequence
  Description of Artificial Sequence: Synthetic oligonucleotide
  modified_base (8)..(8): a, c, t, g, unknown or other
ttgagtrnga

SEQ ID NO: 2406 - DNA, 10 bp, Artificial Sequence
  Description of Artificial Sequence: Synthetic oligonucleotide
  modified_base (8)..(8): a, c, t, g, unknown or other
ttgagtrngc

SEQ ID NO: 2407 - DNA, 10 bp, Artificial Sequence
  Description of Artificial Sequence: Synthetic oligonucleotide
  modified_base (8)..(8): a, c, t, g, unknown or other
ttgagtrngg

SEQ ID NO: 2408 - DNA, 10 bp, Artificial Sequence
  Description of Artificial Sequence: Synthetic oligonucleotide
  modified_base (8)..(8): a, c, t, g, unknown or other
ttgagtrngt

SEQ ID NO: 2409 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
  modified_base (10)..(10): a, c, t, g, unknown or other
angagtangn

SEQ ID NO: 2410 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
angagtaagn

SEQ ID NO: 2411 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
angagtacgn

SEQ ID NO: 2412 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
angagtaggn

SEQ ID NO: 2413 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
  modified_base (10)..(10): a, c, t, g, unknown or other
nagagtangn

SEQ ID NO: 2414 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
nagagtaagn

SEQ ID NO: 2415 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
nagagtacgn

SEQ ID NO: 2416 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
nagagtaggn

SEQ ID NO: 2417 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
aagagtangn

SEQ ID NO: 2418 - DNA, 10 bp, Artificial Sequence
  Description of Artificial Sequence: Synthetic oligonucleotide
  modified_base (10)..(10): a, c, t, g, unknown or other
aagagtaagn

SEQ ID NO: 2419 - DNA, 10 bp, Artificial Sequence
  Description of Artificial Sequence: Synthetic oligonucleotide
  modified_base (10)..(10): a, c, t, g, unknown or other
aagagtacgn

SEQ ID NO: 2420 - DNA, 10 bp, Artificial Sequence
  Description of Artificial Sequence: Synthetic oligonucleotide
  modified_base (10)..(10): a, c, t, g, unknown or other
aagagtaggn

SEQ ID NO: 2421 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
cagagtangn

SEQ ID NO: 2422 - DNA, 10 bp, Artificial Sequence
  Description of Artificial Sequence: Synthetic oligonucleotide
  modified_base (10)..(10): a, c, t, g, unknown or other
cagagtaagn

SEQ ID NO: 2423 - DNA, 10 bp, Artificial Sequence
  Description of Artificial Sequence: Synthetic oligonucleotide
  modified_base (10)..(10): a, c, t, g, unknown or other
cagagtacgn

SEQ ID NO: 2424 - DNA, 10 bp, Artificial Sequence
  Description of Artificial Sequence: Synthetic oligonucleotide
  modified_base (10)..(10): a, c, t, g, unknown or other
cagagtaggn

SEQ ID NO: 2425 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
gagagtangn

SEQ ID NO: 2426 - DNA, 10 bp, Artificial Sequence
  Description of Artificial Sequence: Synthetic oligonucleotide
  modified_base (10)..(10): a, c, t, g, unknown or other
gagagtaagn

SEQ ID NO: 2427 - DNA, 10 bp, Artificial Sequence
  Description of Artificial Sequence: Synthetic oligonucleotide
  modified_base (10)..(10): a, c, t, g, unknown or other
gagagtacgn

SEQ ID NO: 2428 - DNA, 10 bp, Artificial Sequence
  Description of Artificial Sequence: Synthetic oligonucleotide
  modified_base (10)..(10): a, c, t, g, unknown or other
gagagtaggn

SEQ ID NO: 2429 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
tagagtangn

SEQ ID NO: 2430 - DNA, 10 bp, Artificial Sequence
  Description of Artificial Sequence: Synthetic oligonucleotide
  modified_base (10)..(10): a, c, t, g, unknown or other
tagagtaagn

SEQ ID NO: 2431 - DNA, 10 bp, Artificial Sequence
  Description of Artificial Sequence: Synthetic oligonucleotide
  modified_base (10)..(10): a, c, t, g, unknown or other
tagagtacgn

SEQ ID NO: 2432 - DNA, 10 bp, Artificial Sequence
  Description of Artificial Sequence: Synthetic oligonucleotide
  modified_base (10)..(10): a, c, t, g, unknown or other
tagagtaggn

SEQ ID NO: 2433 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
  modified_base (10)..(10): a, c, t, g, unknown or other
cngagtangn

SEQ ID NO: 2434 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
cngagtaagn

SEQ ID NO: 2435 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
cngagtacgn

SEQ ID NO: 2436 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
cngagtaggn

SEQ ID NO: 2437 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
  modified_base (10)..(10): a, c, t, g, unknown or other
ncgagtangn

SEQ ID NO: 2438 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
ncgagtaagn

SEQ ID NO: 2439 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
ncgagtacgn

SEQ ID NO: 2440 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
ncgagtaggn

SEQ ID NO: 2441 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
acgagtangn

SEQ ID NO: 2442 - DNA, 10 bp, Artificial Sequence
  Description of Artificial Sequence: Synthetic oligonucleotide
  modified_base (10)..(10): a, c, t, g, unknown or other
acgagtaagn

SEQ ID NO: 2443 - DNA, 10 bp, Artificial Sequence
  Description of Artificial Sequence: Synthetic oligonucleotide
  modified_base (10)..(10): a, c, t, g, unknown or other
acgagtacgn

SEQ ID NO: 2444 - DNA, 10 bp, Artificial Sequence
  Description of Artificial Sequence: Synthetic oligonucleotide
  modified_base (10)..(10): a, c, t, g, unknown or other
acgagtaggn

SEQ ID NO: 2445 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
ccgagtangn

SEQ ID NO: 2446 - DNA, 10 bp, Artificial Sequence
  Description of Artificial Sequence: Synthetic oligonucleotide
  modified_base (10)..(10): a, c, t, g, unknown or other
ccgagtaagn

SEQ ID NO: 2447 - DNA, 10 bp, Artificial Sequence
  Description of Artificial Sequence: Synthetic oligonucleotide
  modified_base (10)..(10): a, c, t, g, unknown or other
ccgagtacgn

SEQ ID NO: 2448 - DNA, 10 bp, Artificial Sequence
  Description of Artificial Sequence: Synthetic oligonucleotide
  modified_base (10)..(10): a, c, t, g, unknown or other
ccgagtaggn

SEQ ID NO: 2449 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
gcgagtangn

SEQ ID NO: 2450 - DNA, 10 bp, Artificial Sequence
  Description of Artificial Sequence: Synthetic oligonucleotide
  modified_base (10)..(10): a, c, t, g, unknown or other
gcgagtaagn

SEQ ID NO: 2451 - DNA, 10 bp, Artificial Sequence
  Description of Artificial Sequence: Synthetic oligonucleotide
  modified_base (10)..(10): a, c, t, g, unknown or other
gcgagtacgn

SEQ ID NO: 2452 - DNA, 10 bp, Artificial Sequence
  Description of Artificial Sequence: Synthetic oligonucleotide
  modified_base (10)..(10): a, c, t, g, unknown or other
gcgagtaggn

SEQ ID NO: 2453 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
tcgagtangn

SEQ ID NO: 2454 - DNA, 10 bp, Artificial Sequence
  Description of Artificial Sequence: Synthetic oligonucleotide
  modified_base (10)..(10): a, c, t, g, unknown or other
tcgagtaagn

SEQ ID NO: 2455 - DNA, 10 bp, Artificial Sequence
  Description of Artificial Sequence: Synthetic oligonucleotide
  modified_base (10)..(10): a, c, t, g, unknown or other
tcgagtacgn

SEQ ID NO: 2456 - DNA, 10 bp, Artificial Sequence
  Description of Artificial Sequence: Synthetic oligonucleotide
  modified_base (10)..(10): a, c, t, g, unknown or other
tcgagtaggn

SEQ ID NO: 2457 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
  modified_base (10)..(10): a, c, t, g, unknown or other
gngagtangn

SEQ ID NO: 2458 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
gngagtaagn

SEQ ID NO: 2459 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
gngagtacgn

SEQ ID NO: 2460 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
gngagtaggn

SEQ ID NO: 2461 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
  modified_base (10)..(10): a, c, t, g, unknown or other
nggagtangn

SEQ ID NO: 2462 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
nggagtaagn

SEQ ID NO: 2463 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
nggagtacgn

SEQ ID NO: 2464 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
nggagtaggn

SEQ ID NO: 2465 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
aggagtangn

SEQ ID NO: 2466 - DNA, 10 bp, Artificial Sequence
  Description of Artificial Sequence: Synthetic oligonucleotide
  modified_base (10)..(10): a, c, t, g, unknown or other
aggagtaagn

SEQ ID NO: 2467 - DNA, 10 bp, Artificial Sequence
  Description of Artificial Sequence: Synthetic oligonucleotide
  modified_base (10)..(10): a, c, t, g, unknown or other
aggagtacgn

SEQ ID NO: 2468 - DNA, 10 bp, Artificial Sequence
  Description of Artificial Sequence: Synthetic oligonucleotide
  modified_base (10)..(10): a, c, t, g, unknown or other
aggagtaggn

SEQ ID NO: 2469 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
cggagtangn

SEQ ID NO: 2470 - DNA, 10 bp, Artificial Sequence
  Description of Artificial Sequence: Synthetic oligonucleotide
  modified_base (10)..(10): a, c, t, g, unknown or other
cggagtaagn

SEQ ID NO: 2471 - DNA, 10 bp, Artificial Sequence
  Description of Artificial Sequence: Synthetic oligonucleotide
  modified_base (10)..(10): a, c, t, g, unknown or other
cggagtacgn

SEQ ID NO: 2472 - DNA, 10 bp, Artificial Sequence
  Description of Artificial Sequence: Synthetic oligonucleotide
  modified_base (10)..(10): a, c, t, g, unknown or other
cggagtaggn

SEQ ID NO: 2473 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
gggagtangn

SEQ ID NO: 2474 - DNA, 10 bp, Artificial Sequence
  Description of Artificial Sequence: Synthetic oligonucleotide
  modified_base (10)..(10): a, c, t, g, unknown or other
gggagtaagn

SEQ ID NO: 2475 - DNA, 10 bp, Artificial Sequence
  Description of Artificial Sequence: Synthetic oligonucleotide
  modified_base (10)..(10): a, c, t, g, unknown or other
gggagtacgn

SEQ ID NO: 2476 - DNA, 10 bp, Artificial Sequence
  Description of Artificial Sequence: Synthetic oligonucleotide
  modified_base (10)..(10): a, c, t, g, unknown or other
gggagtaggn

SEQ ID NO: 2477 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
tggagtangn

SEQ ID NO: 2478 - DNA, 10 bp, Artificial Sequence
  Description of Artificial Sequence: Synthetic oligonucleotide
  modified_base (10)..(10): a, c, t, g, unknown or other
tggagtaagn

SEQ ID NO: 2479 - DNA, 10 bp, Artificial Sequence
  Description of Artificial Sequence: Synthetic oligonucleotide
  modified_base (10)..(10): a, c, t, g, unknown or other
tggagtacgn

SEQ ID NO: 2480 - DNA, 10 bp, Artificial Sequence
  Description of Artificial Sequence: Synthetic oligonucleotide
  modified_base (10)..(10): a, c, t, g, unknown or other
tggagtaggn

SEQ ID NO: 2481 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
  modified_base (10)..(10): a, c, t, g, unknown or other
tngagtangn

SEQ ID NO: 2482 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
tngagtaagn

SEQ ID NO: 2483 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
tngagtacgn

SEQ ID NO: 2484 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
tngagtaggn

SEQ ID NO: 2485 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
  modified_base (10)..(10): a, c, t, g, unknown or other
ntgagtangn

SEQ ID NO: 2486 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
ntgagtaagn

SEQ ID NO: 2487 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
ntgagtacgn

SEQ ID NO: 2488 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
ntgagtaggn

SEQ ID NO: 2489 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
atgagtangn

SEQ ID NO: 2490 - DNA, 10 bp, Artificial Sequence
  Description of Artificial Sequence: Synthetic oligonucleotide
  modified_base (10)..(10): a, c, t, g, unknown or other
atgagtaagn

SEQ ID NO: 2491 - DNA, 10 bp, Artificial Sequence
  Description of Artificial Sequence: Synthetic oligonucleotide
  modified_base (10)..(10): a, c, t, g, unknown or other
atgagtacgn

SEQ ID NO: 2492 - DNA, 10 bp, Artificial Sequence
  Description of Artificial Sequence: Synthetic oligonucleotide
  modified_base (10)..(10): a, c, t, g, unknown or other
atgagtaggn

SEQ ID NO: 2493 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
ctgagtangn

SEQ ID NO: 2494 - DNA, 10 bp, Artificial Sequence
  Description of Artificial Sequence: Synthetic oligonucleotide
  modified_base (10)..(10): a, c, t, g, unknown or other
ctgagtaagn

SEQ ID NO: 2495 - DNA, 10 bp, Artificial Sequence
  Description of Artificial Sequence: Synthetic oligonucleotide
  modified_base (10)..(10): a, c, t, g, unknown or other
ctgagtacgn

SEQ ID NO: 2496 - DNA, 10 bp, Artificial Sequence
  Description of Artificial Sequence: Synthetic oligonucleotide
  modified_base (10)..(10): a, c, t, g, unknown or other
ctgagtaggn

SEQ ID NO: 2497 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
gtgagtangn

SEQ ID NO: 2498 - DNA, 10 bp, Artificial Sequence
  Description of Artificial Sequence: Synthetic oligonucleotide
  modified_base (10)..(10): a, c, t, g, unknown or other
gtgagtaagn

SEQ ID NO: 2499 - DNA, 10 bp, Artificial Sequence
  Description of Artificial Sequence: Synthetic oligonucleotide
  modified_base (10)..(10): a, c, t, g, unknown or other
gtgagtacgn

SEQ ID NO: 2500 - DNA, 10 bp, Artificial Sequence
  Description of Artificial Sequence: Synthetic oligonucleotide
  modified_base (10)..(10): a, c, t, g, unknown or other
gtgagtaggn

SEQ ID NO: 2501 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
ttgagtangn

SEQ ID NO: 2502 - DNA, 10 bp, Artificial Sequence
  Description of Artificial Sequence: Synthetic oligonucleotide
  modified_base (10)..(10): a, c, t, g, unknown or other
ttgagtaagn

SEQ ID NO: 2503 - DNA, 10 bp, Artificial Sequence
  Description of Artificial Sequence: Synthetic oligonucleotide
  modified_base (10)..(10): a, c, t, g, unknown or other
ttgagtacgn

SEQ ID NO: 2504 - DNA, 10 bp, Artificial Sequence
  Description of Artificial Sequence: Synthetic oligonucleotide
  modified_base (10)..(10): a, c, t, g, unknown or other
ttgagtaggn

SEQ ID NO: 2505 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
angagtatgn

SEQ ID NO: 2506 - DNA, 10 bp, Artificial Sequence
  Description of Artificial Sequence: Synthetic oligonucleotide
  modified_base (2)..(2): a, c, t, g, unknown or other
angagtaaga

SEQ ID NO: 2507 - DNA, 10 bp, Artificial Sequence
  Description of Artificial Sequence: Synthetic oligonucleotide
  modified_base (2)..(2): a, c, t, g, unknown or other
angagtacga

SEQ ID NO: 2508 - DNA, 10 bp, Artificial Sequence
  Description of Artificial Sequence: Synthetic oligonucleotide
  modified_base (2)..(2): a, c, t, g, unknown or other
angagtagga

SEQ ID NO: 2509 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
nagagtatgn

SEQ ID NO: 2510 - DNA, 10 bp, Artificial Sequence
  Description of Artificial Sequence: Synthetic oligonucleotide
  modified_base (1)..(1): a, c, t, g, unknown or other
nagagtaaga

SEQ ID NO: 2511 - DNA, 10 bp, Artificial Sequence
  Description of Artificial Sequence: Synthetic oligonucleotide
  modified_base (1)..(1): a, c, t, g, unknown or other
nagagtacga

SEQ ID NO: 2512 - DNA, 10 bp, Artificial Sequence
  Description of Artificial Sequence: Synthetic oligonucleotide
  modified_base (1)..(1): a, c, t, g, unknown or other
nagagtagga

SEQ ID NO: 2513 - DNA, 10 bp, Artificial Sequence
  Description of Artificial Sequence: Synthetic oligonucleotide
  modified_base (10)..(10): a, c, t, g, unknown or other
aagagtatgn

SEQ ID NO: 2514 - DNA, 10 bp, Artificial Sequence
  Description of Artificial Sequence: Synthetic oligonucleotide
aagagtaaga

SEQ ID NO: 2515 - DNA, 10 bp, Artificial Sequence
  Description of Artificial Sequence: Synthetic oligonucleotide
aagagtacga

SEQ ID NO: 2516 - DNA, 10 bp, Artificial Sequence
  Description of Artificial Sequence: Synthetic oligonucleotide
aagagtagga

SEQ ID NO: 2517 - DNA, 10 bp, Artificial Sequence
  Description of Artificial Sequence: Synthetic oligonucleotide
  modified_base (10)..(10): a, c, t, g, unknown or other
cagagtatgn

SEQ ID NO: 2518 - DNA, 10 bp, Artificial Sequence
  Description of Artificial Sequence: Synthetic oligonucleotide
cagagtaaga

SEQ ID NO: 2519 - DNA, 10 bp, Artificial Sequence
  Description of Artificial Sequence: Synthetic oligonucleotide
cagagtacga

SEQ ID NO: 2520 - DNA, 10 bp, Artificial Sequence
  Description of Artificial Sequence: Synthetic oligonucleotide
cagagtagga

SEQ ID NO: 2521 - DNA, 10 bp, Artificial Sequence
  Description of Artificial Sequence: Synthetic oligonucleotide
  modified_base (10)..(10): a, c, t, g, unknown or other
gagagtatgn

SEQ ID NO: 2522 - DNA, 10 bp, Artificial Sequence
  Description of Artificial Sequence: Synthetic oligonucleotide
gagagtaaga

SEQ ID NO: 2523 - DNA, 10 bp, Artificial Sequence
  Description of Artificial Sequence: Synthetic oligonucleotide
gagagtacga

SEQ ID NO: 2524 - DNA, 10 bp, Artificial Sequence
  Description of Artificial Sequence: Synthetic oligonucleotide
gagagtagga

SEQ ID NO: 2525 - DNA, 10 bp, Artificial Sequence
  Description of Artificial Sequence: Synthetic oligonucleotide
  modified_base (10)..(10): a, c, t, g, unknown or other
tagagtatgn

SEQ ID NO: 2526 - DNA, 10 bp, Artificial Sequence
  Description of Artificial Sequence: Synthetic oligonucleotide
tagagtaaga

SEQ ID NO: 2527 - DNA, 10 bp, Artificial Sequence
  Description of Artificial Sequence: Synthetic oligonucleotide
tagagtacga

SEQ ID NO: 2528 - DNA, 10 bp, Artificial Sequence
  Description of Artificial Sequence: Synthetic oligonucleotide
tagagtagga

SEQ ID NO: 2529 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
cngagtatgn

SEQ ID NO: 2530 - DNA, 10 bp, Artificial Sequence
  Description of Artificial Sequence: Synthetic oligonucleotide
  modified_base (2)..(2): a, c, t, g, unknown or other
cngagtaaga

SEQ ID NO: 2531 - DNA, 10 bp, Artificial Sequence
  Description of Artificial Sequence: Synthetic oligonucleotide
  modified_base (2)..(2): a, c, t, g, unknown or other
cngagtacga

SEQ ID NO: 2532 - DNA, 10 bp, Artificial Sequence
  Description of Artificial Sequence: Synthetic oligonucleotide
  modified_base (2)..(2): a, c, t, g, unknown or other
cngagtagga

SEQ ID NO: 2533 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
ncgagtatgn

SEQ ID NO: 2534 - DNA, 10 bp, Artificial Sequence
  Description of Artificial Sequence: Synthetic oligonucleotide
  modified_base (1)..(1): a, c, t, g, unknown or other
ncgagtaaga

SEQ ID NO: 2535 - DNA, 10 bp, Artificial Sequence
  Description of Artificial Sequence: Synthetic oligonucleotide
  modified_base (1)..(1): a, c, t, g, unknown or other
ncgagtacga

SEQ ID NO: 2536 - DNA, 10 bp, Artificial Sequence
  Description of Artificial Sequence: Synthetic oligonucleotide
  modified_base (1)..(1): a, c, t, g, unknown or other
ncgagtagga

SEQ ID NO: 2537 - DNA, 10 bp, Artificial Sequence
  Description of Artificial Sequence: Synthetic oligonucleotide
  modified_base (10)..(10): a, c, t, g, unknown or other
acgagtatgn

SEQ ID NO: 2538 - DNA, 10 bp, Artificial Sequence
  Description of Artificial Sequence: Synthetic oligonucleotide
acgagtaaga

SEQ ID NO: 2539 - DNA, 10 bp, Artificial Sequence
  Description of Artificial Sequence: Synthetic oligonucleotide
acgagtacga

SEQ ID NO: 2540 - DNA, 10 bp, Artificial Sequence
  Description of Artificial Sequence: Synthetic oligonucleotide
acgagtagga

SEQ ID NO: 2541 - DNA, 10 bp, Artificial Sequence
  Description of Artificial Sequence: Synthetic oligonucleotide
  modified_base (10)..(10): a, c, t, g, unknown or other
ccgagtatgn

SEQ ID NO: 2542 - DNA, 10 bp, Artificial Sequence
  Description of Artificial Sequence: Synthetic oligonucleotide
ccgagtaaga

SEQ ID NO: 2543 - DNA, 10 bp, Artificial Sequence
  Description of Artificial Sequence: Synthetic oligonucleotide
ccgagtacga

SEQ ID NO: 2544 - DNA, 10 bp, Artificial Sequence
  Description of Artificial Sequence: Synthetic oligonucleotide
ccgagtagga

SEQ ID NO: 2545 - DNA, 10 bp, Artificial Sequence
  Description of Artificial Sequence: Synthetic oligonucleotide
  modified_base (10)..(10): a, c, t, g, unknown or other
gcgagtatgn

SEQ ID NO: 2546 - DNA, 10 bp, Artificial Sequence
  Description of Artificial Sequence: Synthetic oligonucleotide
gcgagtaaga

SEQ ID NO: 2547 - DNA, 10 bp, Artificial Sequence
  Description of Artificial Sequence: Synthetic oligonucleotide
gcgagtacga

SEQ ID NO: 2548 - DNA, 10 bp, Artificial Sequence
  Description of Artificial Sequence: Synthetic oligonucleotide
gcgagtagga

SEQ ID NO: 2549 - DNA, 10 bp, Artificial Sequence
  Description of Artificial Sequence: Synthetic oligonucleotide
  modified_base (10)..(10): a, c, t, g, unknown or other
tcgagtatgn

SEQ ID NO: 2550 - DNA, 10 bp, Artificial Sequence
  Description of Artificial Sequence: Synthetic oligonucleotide
tcgagtaaga

SEQ ID NO: 2551 - DNA, 10 bp, Artificial Sequence
  Description of Artificial Sequence: Synthetic oligonucleotide
tcgagtacga

SEQ ID NO: 2552 - DNA, 10 bp, Artificial Sequence
  Description of Artificial Sequence: Synthetic oligonucleotide
tcgagtagga

SEQ ID NO: 2553 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
gngagtatgn

SEQ ID NO: 2554 - DNA, 10 bp, Artificial Sequence
  Description of Artificial Sequence: Synthetic oligonucleotide
  modified_base (2)..(2): a, c, t, g, unknown or other
gngagtaaga

SEQ ID NO: 2555 - DNA, 10 bp, Artificial Sequence
  Description of Artificial Sequence: Synthetic oligonucleotide
  modified_base (2)..(2): a, c, t, g, unknown or other
gngagtacga

SEQ ID NO: 2556 - DNA, 10 bp, Artificial Sequence
  Description of Artificial Sequence: Synthetic oligonucleotide
  modified_base (2)..(2): a, c, t, g, unknown or other
gngagtagga

SEQ ID NO: 2557 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
nggagtatgn

SEQ ID NO: 2558 - DNA, 10 bp, Artificial Sequence
  Description of Artificial Sequence: Synthetic oligonucleotide
  modified_base (1)..(1): a, c, t, g, unknown or other
nggagtaaga

SEQ ID NO: 2559 - DNA, 10 bp, Artificial Sequence
  Description of Artificial Sequence: Synthetic oligonucleotide
  modified_base (1)..(1): a, c, t, g, unknown or other
nggagtacga

SEQ ID NO: 2560 - DNA, 10 bp, Artificial Sequence
  Description of Artificial Sequence: Synthetic oligonucleotide
  modified_base (1)..(1): a, c, t, g, unknown or other
nggagtagga

SEQ ID NO: 2561 - DNA, 10 bp, Artificial Sequence
  Description of Artificial Sequence: Synthetic oligonucleotide
  modified_base (10)..(10): a, c, t, g, unknown or other
aggagtatgn

SEQ ID NO: 2562 - DNA, 10 bp, Artificial Sequence
  Description of Artificial Sequence: Synthetic oligonucleotide
aggagtaaga

SEQ ID NO: 2563 - DNA, 10 bp, Artificial Sequence
  Description of Artificial Sequence: Synthetic oligonucleotide
aggagtacga

SEQ ID NO: 2564 - DNA, 10 bp, Artificial Sequence
  Description of Artificial Sequence: Synthetic oligonucleotide
aggagtagga

SEQ ID NO: 2565 - DNA, 10 bp, Artificial Sequence
  Description of Artificial Sequence: Synthetic oligonucleotide
  modified_base (10)..(10): a, c, t, g, unknown or other
cggagtatgn

SEQ ID NO: 2566 - DNA, 10 bp, Artificial Sequence
  Description of Artificial Sequence: Synthetic oligonucleotide
cggagtaaga

SEQ ID NO: 2567 - DNA, 10 bp, Artificial Sequence
  Description of Artificial Sequence: Synthetic oligonucleotide
cggagtacga

SEQ ID NO: 2568 - DNA, 10 bp, Artificial Sequence
  Description of Artificial Sequence: Synthetic oligonucleotide
cggagtagga

SEQ ID NO: 2569 - DNA, 10 bp, Artificial Sequence
  Description of Artificial Sequence: Synthetic oligonucleotide
  modified_base (10)..(10): a, c, t, g, unknown or other
gggagtatgn

SEQ ID NO: 2570 - DNA, 10 bp, Artificial Sequence
  Description of Artificial Sequence: Synthetic oligonucleotide
gggagtaaga

SEQ ID NO: 2571 - DNA, 10 bp, Artificial Sequence
  Description of Artificial Sequence: Synthetic oligonucleotide
gggagtacga

SEQ ID NO: 2572 - DNA, 10 bp, Artificial Sequence
  Description of Artificial Sequence: Synthetic oligonucleotide
gggagtagga

SEQ ID NO: 2573 - DNA, 10 bp, Artificial Sequence
  Description of Artificial Sequence: Synthetic oligonucleotide
  modified_base (10)..(10): a, c, t, g, unknown or other
tggagtatgn

SEQ ID NO: 2574 - DNA, 10 bp, Artificial Sequence
  Description of Artificial Sequence: Synthetic oligonucleotide
tggagtaaga

SEQ ID NO: 2575 - DNA, 10 bp, Artificial Sequence
  Description of Artificial Sequence: Synthetic oligonucleotide
tggagtacga

SEQ ID NO: 2576 - DNA, 10 bp, Artificial Sequence
  Description of Artificial Sequence: Synthetic oligonucleotide
tggagtagga

SEQ ID NO: 2577 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
tngagtatgn

SEQ ID NO: 2578 - DNA, 10 bp, Artificial Sequence
  Description of Artificial Sequence: Synthetic oligonucleotide
  modified_base (2)..(2): a, c, t, g, unknown or other
tngagtaaga

SEQ ID NO: 2579 - DNA, 10 bp, Artificial Sequence
  Description of Artificial Sequence: Synthetic oligonucleotide
  modified_base (2)..(2): a, c, t, g, unknown or other
tngagtacga

SEQ ID NO: 2580 - DNA, 10 bp, Artificial Sequence
  Description of Artificial Sequence: Synthetic oligonucleotide
  modified_base (2)..(2): a, c, t, g, unknown or other
tngagtagga

SEQ ID NO: 2581 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
ntgagtatgn

SEQ ID NO: 2582 - DNA, 10 bp, Artificial Sequence
  Description of Artificial Sequence: Synthetic oligonucleotide
  modified_base (1)..(1): a, c, t, g, unknown or other
ntgagtaaga

SEQ ID NO: 2583 - DNA, 10 bp, Artificial Sequence
  Description of Artificial Sequence: Synthetic oligonucleotide
  modified_base (1)..(1): a, c, t, g, unknown or other
ntgagtacga

SEQ ID NO: 2584 - DNA, 10 bp, Artificial Sequence
  Description of Artificial Sequence: Synthetic oligonucleotide
  modified_base (1)..(1): a, c, t, g, unknown or other
ntgagtagga

SEQ ID NO: 2585 - DNA, 10 bp, Artificial Sequence
  Description of Artificial Sequence: Synthetic oligonucleotide
  modified_base (10)..(10): a, c, t, g, unknown or other
atgagtatgn

SEQ ID NO: 2586 - DNA, 10 bp, Artificial Sequence
  Description of Artificial Sequence: Synthetic oligonucleotide
atgagtaaga

SEQ ID NO: 2587 - DNA, 10 bp, Artificial Sequence
  Description of Artificial Sequence: Synthetic oligonucleotide
atgagtacga

SEQ ID NO: 2588 - DNA, 10 bp, Artificial Sequence
  Description of Artificial Sequence: Synthetic oligonucleotide
atgagtagga

SEQ ID NO: 2589 - DNA, 10 bp, Artificial Sequence
  Description of Artificial Sequence: Synthetic oligonucleotide
  modified_base (10)..(10): a, c, t, g, unknown or other
ctgagtatgn

SEQ ID NO: 2590 - DNA, 10 bp, Artificial Sequence
  Description of Artificial Sequence: Synthetic oligonucleotide
ctgagtaaga

SEQ ID NO: 2591 - DNA, 10 bp, Artificial Sequence
  Description of Artificial Sequence: Synthetic oligonucleotide
ctgagtacga

SEQ ID NO: 2592 - DNA, 10 bp, Artificial Sequence
  Description of Artificial Sequence: Synthetic oligonucleotide
ctgagtagga

SEQ ID NO: 2593 - DNA, 10 bp, Artificial Sequence
  Description of Artificial Sequence: Synthetic oligonucleotide
  modified_base (10)..(10): a, c, t, g, unknown or other
gtgagtatgn

SEQ ID NO: 2594 - DNA, 10 bp, Artificial Sequence
  Description of Artificial Sequence: Synthetic oligonucleotide
gtgagtaaga

SEQ ID NO: 2595 - DNA, 10 bp, Artificial Sequence
  Description of Artificial Sequence: Synthetic oligonucleotide
gtgagtacga

SEQ ID NO: 2596 - DNA, 10 bp, Artificial Sequence
  Description of Artificial Sequence: Synthetic oligonucleotide
gtgagtagga

SEQ ID NO: 2597 - DNA, 10 bp, Artificial Sequence
  Description of Artificial Sequence: Synthetic oligonucleotide
  modified_base (10)..(10): a, c, t, g, unknown or other
ttgagtatgn

SEQ ID NO: 2598 - DNA, 10 bp, Artificial Sequence
  Description of Artificial Sequence: Synthetic oligonucleotide
ttgagtaaga

SEQ ID NO: 2599 - DNA, 10 bp, Artificial Sequence
  Description of Artificial Sequence: Synthetic oligonucleotide
ttgagtacga

SEQ ID NO: 2600 - DNA, 10 bp, Artificial Sequence
  Description of Artificial Sequence: Synthetic oligonucleotide
ttgagtagga

SEQ ID NO: 2601 - DNA, 10 bp, Artificial Sequence
  Description of Artificial Sequence: Synthetic oligonucleotide
  modified_base (2)..(2): a, c, t, g, unknown or other
angagtatga

SEQ ID NO: 2602 - DNA, 10 bp, Artificial Sequence
  Description of Artificial Sequence: Synthetic oligonucleotide
  modified_base (2)..(2): a, c, t, g, unknown or other
angagtaagc

SEQ ID NO: 2603 - DNA, 10 bp, Artificial Sequence
  Description of Artificial Sequence: Synthetic oligonucleotide
  modified_base (2)..(2): a, c, t, g, unknown or other
angagtacgc

SEQ ID NO: 2604 - DNA, 10 bp, Artificial Sequence
  Description of Artificial Sequence: Synthetic oligonucleotide
  modified_base (2)..(2): a, c, t, g, unknown or other
angagtaggc

SEQ ID NO: 2605 - DNA, 10 bp, Artificial Sequence
  Description of Artificial Sequence: Synthetic oligonucleotide
  modified_base (1)..(1): a, c, t, g, unknown or other
nagagtatga

SEQ ID NO: 2606 - DNA, 10 bp, Artificial Sequence
  Description of Artificial Sequence: Synthetic oligonucleotide
  modified_base (1)..(1): a, c, t, g, unknown or other
nagagtaagc

SEQ ID NO: 2607 - DNA, 10 bp, Artificial Sequence
  Description of Artificial Sequence: Synthetic oligonucleotide
  modified_base (1)..(1): a, c, t, g, unknown or other
nagagtacgc

SEQ ID NO: 2608 - DNA, 10 bp, Artificial Sequence
  Description of Artificial Sequence: Synthetic oligonucleotide
  modified_base (1)..(1): a, c, t, g, unknown or other
nagagtaggc

SEQ ID NO: 2609 - DNA, 10 bp, Artificial Sequence
  Description of Artificial Sequence: Synthetic oligonucleotide
aagagtatga

SEQ ID NO: 2610 - DNA, 10 bp, Artificial Sequence
  Description of Artificial Sequence: Synthetic oligonucleotide
aagagtaagc

SEQ ID NO: 2611 - DNA, 10 bp, Artificial Sequence
  Description of Artificial Sequence: Synthetic oligonucleotide
aagagtacgc

SEQ ID NO: 2612 - DNA, 10 bp, Artificial Sequence
  Description of Artificial Sequence: Synthetic oligonucleotide
aagagtaggc

SEQ ID NO: 2613 - DNA, 10 bp, Artificial Sequence
  Description of Artificial Sequence: Synthetic oligonucleotide
cagagtatga

SEQ ID NO: 2614 - DNA, 10 bp, Artificial Sequence
  Description of Artificial Sequence: Synthetic oligonucleotide
cagagtaagc

SEQ ID NO: 2615 - DNA, 10 bp, Artificial Sequence
  Description of Artificial Sequence: Synthetic oligonucleotide
cagagtacgc

SEQ ID NO: 2616 - DNA, 10 bp, Artificial Sequence
  Description of Artificial Sequence: Synthetic oligonucleotide
cagagtaggc

SEQ ID NO: 2617 - DNA, 10 bp, Artificial Sequence
  Description of Artificial Sequence: Synthetic oligonucleotide
gagagtatga

SEQ ID NO: 2618 - DNA, 10 bp, Artificial Sequence
  Description of Artificial Sequence: Synthetic oligonucleotide
gagagtaagc

SEQ ID NO: 2619 - DNA, 10 bp, Artificial Sequence
  Description of Artificial Sequence: Synthetic oligonucleotide
gagagtacgc

SEQ ID NO: 2620 - DNA, 10 bp, Artificial Sequence
  Description of Artificial Sequence: Synthetic oligonucleotide
gagagtaggc

SEQ ID NO: 2621 - DNA, 10 bp, Artificial Sequence
  Description of Artificial Sequence: Synthetic oligonucleotide
tagagtatga

SEQ ID NO: 2622 - DNA, 10 bp, Artificial Sequence
  Description of Artificial Sequence: Synthetic oligonucleotide
tagagtaagc

SEQ ID NO: 2623 - DNA, 10 bp, Artificial Sequence
  Description of Artificial Sequence: Synthetic oligonucleotide
tagagtacgc

SEQ ID NO: 2624 - DNA, 10 bp, Artificial Sequence
  Description of Artificial Sequence: Synthetic oligonucleotide
tagagtaggc

SEQ ID NO: 2625 - DNA, 10 bp, Artificial Sequence
  Description of Artificial Sequence: Synthetic oligonucleotide
  modified_base (2)..(2): a, c, t, g, unknown or other
cngagtatga

SEQ ID NO: 2626 - DNA, 10 bp, Artificial Sequence
  Description of Artificial Sequence: Synthetic oligonucleotide
  modified_base (2)..(2): a, c, t, g, unknown or other
cngagtaagc

SEQ ID NO: 2627 - DNA, 10 bp, Artificial Sequence
  Description of Artificial Sequence: Synthetic oligonucleotide
  modified_base (2)..(2): a, c, t, g, unknown or other
cngagtacgc

SEQ ID NO: 2628 - DNA, 10 bp, Artificial Sequence
  Description of Artificial Sequence: Synthetic oligonucleotide
  modified_base (2)..(2): a, c, t, g, unknown or other
cngagtaggc

SEQ ID NO: 2629 - DNA, 10 bp, Artificial Sequence
  Description of Artificial Sequence: Synthetic oligonucleotide
  modified_base (1)..(1): a, c, t, g, unknown or other
ncgagtatga

SEQ ID NO: 2630 - DNA, 10 bp, Artificial Sequence
  Description of Artificial Sequence: Synthetic oligonucleotide
  modified_base (1)..(1): a, c, t, g, unknown or other
ncgagtaagc

SEQ ID NO: 2631 - DNA, 10 bp, Artificial Sequence
  Description of Artificial Sequence: Synthetic oligonucleotide
  modified_base (1)..(1): a, c, t, g, unknown or other
ncgagtacgc

SEQ ID NO: 2632 - DNA, 10 bp, Artificial Sequence
  Description of Artificial Sequence: Synthetic oligonucleotide
  modified_base (1)..(1): a, c, t, g, unknown or other
ncgagtaggc

SEQ ID NO: 2633 - DNA, 10 bp, Artificial Sequence
  Description of Artificial Sequence: Synthetic oligonucleotide
acgagtatga

SEQ ID NO: 2634 - DNA, 10 bp, Artificial Sequence
  Description of Artificial Sequence: Synthetic oligonucleotide
acgagtaagc

SEQ ID NO: 2635 - DNA, 10 bp, Artificial Sequence
  Description of Artificial Sequence: Synthetic oligonucleotide
acgagtacgc

SEQ ID NO: 2636 - DNA, 10 bp, Artificial Sequence
  Description of Artificial Sequence: Synthetic oligonucleotide
acgagtaggc

SEQ ID NO: 2637 - DNA, 10 bp, Artificial Sequence
  Description of Artificial Sequence: Synthetic oligonucleotide
ccgagtatga

SEQ ID NO: 2638 - DNA, 10 bp, Artificial Sequence
  Description of Artificial Sequence: Synthetic oligonucleotide
ccgagtaagc

SEQ ID NO: 2639 - DNA, 10 bp, Artificial Sequence
  Description of Artificial Sequence: Synthetic oligonucleotide
ccgagtacgc

SEQ ID NO: 2640 - DNA, 10 bp, Artificial Sequence
  Description of Artificial Sequence: Synthetic oligonucleotide
ccgagtaggc

SEQ ID NO: 2641 - DNA, 10 bp, Artificial Sequence
  Description of Artificial Sequence: Synthetic oligonucleotide
gcgagtatga

SEQ ID NO: 2642 - DNA, 10 bp, Artificial Sequence
  Description of Artificial Sequence: Synthetic oligonucleotide
gcgagtaagc

SEQ ID NO: 2643 - DNA, 10 bp, Artificial Sequence
  Description of Artificial Sequence: Synthetic oligonucleotide
gcgagtacgc

SEQ ID NO: 2644 - DNA, 10 bp, Artificial Sequence
  Description of Artificial Sequence: Synthetic oligonucleotide
gcgagtaggc

SEQ ID NO: 2645 - DNA, 10 bp, Artificial Sequence
  Description of Artificial Sequence: Synthetic oligonucleotide
tcgagtatga

SEQ ID NO: 2646 - DNA, 10 bp, Artificial Sequence
  Description of Artificial Sequence: Synthetic oligonucleotide
tcgagtaagc

SEQ ID NO: 2647 - DNA, 10 bp, Artificial Sequence
  Description of Artificial Sequence: Synthetic oligonucleotide
tcgagtacgc

SEQ ID NO: 2648 - DNA, 10 bp, Artificial Sequence
  Description of Artificial Sequence: Synthetic oligonucleotide
tcgagtaggc

SEQ ID NO: 2649 - DNA, 10 bp, Artificial Sequence
  Description of Artificial Sequence: Synthetic oligonucleotide
  modified_base (2)..(2): a, c, t, g, unknown or other
gngagtatga

SEQ ID NO: 2650 - DNA, 10 bp, Artificial Sequence
  Description of Artificial Sequence: Synthetic oligonucleotide
  modified_base (2)..(2): a, c, t, g, unknown or other
gngagtaagc

SEQ ID NO: 2651 - DNA, 10 bp, Artificial Sequence
  Description of Artificial Sequence: Synthetic oligonucleotide
  modified_base (2)..(2): a, c, t, g, unknown or other
gngagtacgc

SEQ ID NO: 2652 - DNA, 10 bp, Artificial Sequence
  Description of Artificial Sequence: Synthetic oligonucleotide
  modified_base (2)..(2): a, c, t, g, unknown or other
gngagtaggc

SEQ ID NO: 2653 - DNA, 10 bp, Artificial Sequence
  Description of Artificial Sequence: Synthetic oligonucleotide
  modified_base (1)..(1): a, c, t, g, unknown or other
nggagtatga

SEQ ID NO: 2654 - DNA, 10 bp, Artificial Sequence
  Description of Artificial Sequence: Synthetic oligonucleotide
  modified_base (1)..(1): a, c, t, g, unknown or other
nggagtaagc

SEQ ID NO: 2655 - DNA, 10 bp, Artificial Sequence
  Description of Artificial Sequence: Synthetic oligonucleotide
  modified_base (1)..(1): a, c, t, g, unknown or other
nggagtacgc

SEQ ID NO: 2656 - DNA, 10 bp, Artificial Sequence
  Description of Artificial Sequence: Synthetic oligonucleotide
  modified_base (1)..(1): a, c, t, g, unknown or other
nggagtaggc

SEQ ID NO: 2657 - DNA, 10 bp, Artificial Sequence
  Description of Artificial Sequence: Synthetic oligonucleotide
aggagtatga

SEQ ID NO: 2658 - DNA, 10 bp, Artificial Sequence
  Description of Artificial Sequence: Synthetic oligonucleotide
aggagtaagc

SEQ ID NO: 2659 - DNA, 10 bp, Artificial Sequence
  Description of Artificial Sequence: Synthetic oligonucleotide
aggagtacgc

SEQ ID NO: 2660 - DNA, 10 bp, Artificial Sequence
  Description of Artificial Sequence: Synthetic oligonucleotide
aggagtaggc

SEQ ID NO: 2661 - DNA, 10 bp, Artificial Sequence
  Description of Artificial Sequence: Synthetic oligonucleotide
cggagtatga

SEQ ID NO: 2662 - DNA, 10 bp, Artificial Sequence
  Description of Artificial Sequence: Synthetic oligonucleotide
cggagtaagc

SEQ ID NO: 2663 - DNA, 10 bp, Artificial Sequence
  Description of Artificial Sequence: Synthetic oligonucleotide
cggagtacgc

SEQ ID NO: 2664 - DNA, 10 bp, Artificial Sequence
  Description of Artificial Sequence: Synthetic oligonucleotide
cggagtaggc

SEQ ID NO: 2665 - DNA, 10 bp, Artificial Sequence
  Description of Artificial Sequence: Synthetic oligonucleotide
gggagtatga

SEQ ID NO: 2666 - DNA, 10 bp, Artificial Sequence
  Description of Artificial Sequence: Synthetic oligonucleotide
gggagtaagc

SEQ ID NO: 2667 - DNA, 10 bp, Artificial Sequence
  Description of Artificial Sequence: Synthetic oligonucleotide
gggagtacgc

SEQ ID NO: 2668 - DNA, 10 bp, Artificial Sequence
  Description of Artificial Sequence: Synthetic oligonucleotide
gggagtaggc

SEQ ID NO: 2669 - DNA, 10 bp, Artificial Sequence
  Description of Artificial Sequence: Synthetic oligonucleotide
tggagtatga

SEQ ID NO: 2670 - DNA, 10 bp, Artificial Sequence
  Description of Artificial Sequence: Synthetic oligonucleotide
tggagtaagc

SEQ ID NO: 2671 - DNA, 10 bp, Artificial Sequence
  Description of Artificial Sequence: Synthetic oligonucleotide
tggagtacgc

SEQ ID NO: 2672 - DNA, 10 bp, Artificial Sequence
  Description of Artificial Sequence: Synthetic oligonucleotide
tggagtaggc

SEQ ID NO: 2673 - DNA, 10 bp, Artificial Sequence
  Description of Artificial Sequence: Synthetic oligonucleotide
  modified_base (2)..(2): a, c, t, g, unknown or other
tngagtatga

SEQ ID NO: 2674 - DNA, 10 bp, Artificial Sequence
  Description of Artificial Sequence: Synthetic oligonucleotide
  modified_base (2)..(2): a, c, t, g, unknown or other
tngagtaagc

SEQ ID NO: 2675 - DNA, 10 bp, Artificial Sequence
  Description of Artificial Sequence: Synthetic oligonucleotide
  modified_base (2)..(2): a, c, t, g, unknown or other
tngagtacgc

SEQ ID NO: 2676 - DNA, 10 bp, Artificial Sequence
  Description of Artificial Sequence: Synthetic oligonucleotide
  modified_base (2)..(2): a, c, t, g, unknown or other
tngagtaggc

SEQ ID NO: 2677 - DNA, 10 bp, Artificial Sequence
  Description of Artificial Sequence: Synthetic oligonucleotide
  modified_base (1)..(1): a, c, t, g, unknown or other
ntgagtatga

SEQ ID NO: 2678 - DNA, 10 bp, Artificial Sequence
  Description of Artificial Sequence: Synthetic oligonucleotide
  modified_base (1)..(1): a, c, t, g, unknown or other
ntgagtaagc

SEQ ID NO: 2679 - DNA, 10 bp, Artificial Sequence
  Description of Artificial Sequence: Synthetic oligonucleotide
  modified_base (1)..(1): a, c, t, g, unknown or other
ntgagtacgc

SEQ ID NO: 2680 - DNA, 10 bp, Artificial Sequence
  Description of Artificial Sequence: Synthetic oligonucleotide
  modified_base (1)..(1): a, c, t, g, unknown or other
ntgagtaggc

SEQ ID NO: 2681 - DNA, 10 bp, Artificial Sequence
  Description of Artificial Sequence: Synthetic oligonucleotide
atgagtatga

SEQ ID NO: 2682 - DNA, 10 bp, Artificial Sequence
  Description of Artificial Sequence: Synthetic oligonucleotide
atgagtaagc

SEQ ID NO: 2683 - DNA, 10 bp, Artificial Sequence
  Description of Artificial Sequence: Synthetic oligonucleotide
atgagtacgc

SEQ ID NO: 2684 - DNA, 10 bp, Artificial Sequence
  Description of Artificial Sequence: Synthetic oligonucleotide
atgagtaggc

SEQ ID NO: 2685 - DNA, 10 bp, Artificial Sequence
  Description of Artificial Sequence: Synthetic oligonucleotide
ctgagtatga

SEQ ID NO: 2686 - DNA, 10 bp, Artificial Sequence
  Description of Artificial Sequence: Synthetic oligonucleotide
ctgagtaagc

SEQ ID NO: 2687 - DNA, 10 bp, Artificial Sequence
  Description of Artificial Sequence: Synthetic oligonucleotide
ctgagtacgc

SEQ ID NO: 2688 - DNA, 10 bp, Artificial Sequence
  Description of Artificial Sequence: Synthetic oligonucleotide
ctgagtaggc

SEQ ID NO: 2689 - DNA, 10 bp, Artificial Sequence
  Description of Artificial Sequence: Synthetic oligonucleotide
gtgagtatga

SEQ ID NO: 2690 - DNA, 10 bp, Artificial Sequence
  Description of Artificial Sequence: Synthetic oligonucleotide
gtgagtaagc

SEQ ID NO: 2691 - DNA, 10 bp, Artificial Sequence
  Description of Artificial Sequence: Synthetic oligonucleotide
gtgagtacgc

SEQ ID NO: 2692 - DNA, 10 bp, Artificial Sequence
  Description of Artificial Sequence: Synthetic oligonucleotide
gtgagtaggc

SEQ ID NO: 2693 - DNA, 10 bp, Artificial Sequence
  Description of Artificial Sequence: Synthetic oligonucleotide
ttgagtatga

SEQ ID NO: 2694 - DNA, 10 bp, Artificial Sequence
  Description of Artificial Sequence: Synthetic oligonucleotide
ttgagtaagc

SEQ ID NO: 2695 - DNA, 10 bp, Artificial Sequence
  Description of Artificial Sequence: Synthetic oligonucleotide
ttgagtacgc

SEQ ID NO: 2696 - DNA, 10 bp, Artificial Sequence
  Description of Artificial Sequence: Synthetic oligonucleotide
ttgagtaggc

SEQ ID NO: 2697 - DNA, 10 bp, Artificial Sequence
  Description of Artificial Sequence: Synthetic oligonucleotide
  modified_base (2)..(2): a, c, t, g, unknown or other
angagtatgc

SEQ ID NO: 2698 - DNA, 10 bp, Artificial Sequence
  Description of Artificial Sequence: Synthetic oligonucleotide
  modified_base (2)..(2): a, c, t, g, unknown or other
angagtaagg

SEQ ID NO: 2699 - DNA, 10 bp, Artificial Sequence
  Description of Artificial Sequence: Synthetic oligonucleotide
  modified_base (2)..(2): a, c, t, g, unknown or other
angagtacgg

SEQ ID NO: 2700 - DNA, 10 bp, Artificial Sequence
  Description of Artificial Sequence: Synthetic oligonucleotide
  modified_base (2)..(2): a, c, t, g, unknown or other
angagtaggg

SEQ ID NO: 2701 - DNA, 10 bp, Artificial Sequence
  Description of Artificial Sequence: Synthetic oligonucleotide
  modified_base (1)..(1): a, c, t, g, unknown or other
nagagtatgc

SEQ ID NO: 2702 - DNA, 10 bp, Artificial Sequence
  Description of Artificial Sequence: Synthetic oligonucleotide
  modified_base (1)..(1): a, c, t, g, unknown or other
nagagtaagg

SEQ ID NO: 2703 - DNA, 10 bp, Artificial Sequence
  Description of Artificial Sequence: Synthetic oligonucleotide
  modified_base (1)..(1): a, c, t, g, unknown or other
nagagtacgg

SEQ ID NO: 2704 - DNA, 10 bp, Artificial Sequence
  Description of Artificial Sequence: Synthetic oligonucleotide
  modified_base (1)..(1): a, c, t, g, unknown or other
nagagtaggg

SEQ ID NO: 2705 - DNA, 10 bp, Artificial Sequence
  Description of Artificial Sequence: Synthetic oligonucleotide
aagagtatgc

SEQ ID NO: 2706 - DNA, 10 bp, Artificial Sequence
  Description of Artificial Sequence: Synthetic oligonucleotide
aagagtaagg

SEQ ID NO: 2707 - DNA, 10 bp, Artificial Sequence
  Description of Artificial Sequence: Synthetic oligonucleotide
aagagtacgg

SEQ ID NO: 2708 - DNA, 10 bp, Artificial Sequence
  Description of Artificial Sequence: Synthetic oligonucleotide
aagagtaggg

SEQ ID NO: 2709 - DNA, 10 bp, Artificial Sequence
  Description of Artificial Sequence: Synthetic oligonucleotide
cagagtatgc

SEQ ID NO: 2710 - DNA, 10 bp, Artificial Sequence
  Description of Artificial Sequence: Synthetic oligonucleotide
cagagtaagg

SEQ ID NO: 2711 - DNA, 10 bp, Artificial Sequence
  Description of Artificial Sequence: Synthetic oligonucleotide
cagagtacgg

SEQ ID NO: 2712 - DNA, 10 bp, Artificial Sequence
  Description of Artificial Sequence: Synthetic oligonucleotide
cagagtaggg

SEQ ID NO: 2713 - DNA, 10 bp, Artificial Sequence
  Description of Artificial Sequence: Synthetic oligonucleotide
gagagtatgc

SEQ ID NO: 2714 - DNA, 10 bp, Artificial Sequence
  Description of Artificial Sequence: Synthetic oligonucleotide
gagagtaagg

SEQ ID NO: 2715 - DNA, 10 bp, Artificial Sequence
  Description of Artificial Sequence: Synthetic oligonucleotide
gagagtacgg

SEQ ID NO: 2716 - DNA, 10 bp, Artificial Sequence
  Description of Artificial Sequence: Synthetic oligonucleotide
gagagtaggg

SEQ ID NO: 2717 - DNA, 10 bp, Artificial Sequence
  Description of Artificial Sequence: Synthetic oligonucleotide
tagagtatgc

SEQ ID NO: 2718 - DNA, 10 bp, Artificial Sequence
  Description of Artificial Sequence: Synthetic oligonucleotide
tagagtaagg

SEQ ID NO: 2719 - DNA, 10 bp, Artificial Sequence
  Description of Artificial Sequence: Synthetic oligonucleotide
tagagtacgg

SEQ ID NO: 2720 - DNA, 10 bp, Artificial Sequence
  Description of Artificial Sequence: Synthetic oligonucleotide
tagagtaggg

SEQ ID NO: 2721 - DNA, 10 bp, Artificial Sequence
  Description of Artificial Sequence: Synthetic oligonucleotide
  modified_base (2)..(2): a, c, t, g, unknown or other
cngagtatgc

SEQ ID NO: 2722 - DNA, 10 bp, Artificial Sequence
  Description of Artificial Sequence: Synthetic oligonucleotide
  modified_base (2)..(2): a, c, t, g, unknown or other
cngagtaagg

SEQ ID NO: 2723 - DNA, 10 bp, Artificial Sequence
  Description of Artificial Sequence: Synthetic oligonucleotide
  modified_base (2)..(2): a, c, t, g, unknown or other
cngagtacgg

SEQ ID NO: 2724 - DNA, 10 bp, Artificial Sequence
  Description of Artificial Sequence: Synthetic oligonucleotide
  modified_base (2)..(2): a, c, t, g, unknown or other
cngagtaggg

SEQ ID NO: 2725 - DNA, 10 bp, Artificial Sequence
  Description of Artificial Sequence: Synthetic oligonucleotide
  modified_base (1)..(1): a, c, t, g, unknown or other
ncgagtatgc

SEQ ID NO: 2726 - DNA, 10 bp, Artificial Sequence
  Description of Artificial Sequence: Synthetic oligonucleotide
  modified_base (1)..(1): a, c, t, g, unknown or other
ncgagtaagg

SEQ ID NO: 2727 - DNA, 10 bp, Artificial Sequence
  Description of Artificial Sequence: Synthetic oligonucleotide
  modified_base (1)..(1): a, c, t, g, unknown or other
ncgagtacgg

SEQ ID NO: 2728 - DNA, 10 bp, Artificial Sequence
  Description of Artificial Sequence: Synthetic oligonucleotide
  modified_base (1)..(1): a, c, t, g, unknown or other
ncgagtaggg

SEQ ID NO: 2729 - DNA, 10 bp, Artificial Sequence
  Description of Artificial Sequence: Synthetic oligonucleotide
acgagtatgc

SEQ ID NO: 2730 - DNA, 10 bp, Artificial Sequence
  Description of Artificial Sequence: Synthetic oligonucleotide
acgagtaagg

SEQ ID NO: 2731 - DNA, 10 bp, Artificial Sequence
  Description of Artificial Sequence: Synthetic oligonucleotide
acgagtacgg

SEQ ID NO: 2732 - DNA, 10 bp, Artificial Sequence
  Description of Artificial Sequence: Synthetic oligonucleotide
acgagtaggg

SEQ ID NO: 2733 - DNA, 10 bp, Artificial Sequence
  Description of Artificial Sequence: Synthetic oligonucleotide
ccgagtatgc

SEQ ID NO: 2734 - DNA, 10 bp, Artificial Sequence
  Description of Artificial Sequence: Synthetic oligonucleotide
ccgagtaagg

SEQ ID NO: 2735 - DNA, 10 bp, Artificial Sequence
  Description of Artificial Sequence: Synthetic oligonucleotide
ccgagtacgg

SEQ ID NO: 2736 - DNA, 10 bp, Artificial Sequence
  Description of Artificial Sequence: Synthetic oligonucleotide
ccgagtaggg

SEQ ID NO: 2737 - DNA, 10 bp, Artificial Sequence
  Description of Artificial Sequence: Synthetic oligonucleotide
gcgagtatgc

SEQ ID NO: 2738 - DNA, 10 bp, Artificial Sequence
  Description of Artificial Sequence: Synthetic oligonucleotide
gcgagtaagg

SEQ ID NO: 2739 - DNA, 10 bp, Artificial Sequence
  Description of Artificial Sequence: Synthetic oligonucleotide
gcgagtacgg

SEQ ID NO: 2740 - DNA, 10 bp, Artificial Sequence
  Description of Artificial Sequence: Synthetic oligonucleotide
gcgagtaggg

SEQ ID NO: 2741 - DNA, 10 bp, Artificial Sequence
  Description of Artificial Sequence: Synthetic oligonucleotide
tcgagtatgc

SEQ ID NO: 2742 - DNA, 10 bp, Artificial Sequence
  Description of Artificial Sequence: Synthetic oligonucleotide
tcgagtaagg

SEQ ID NO: 2743 - DNA, 10 bp, Artificial Sequence
  Description of Artificial Sequence: Synthetic oligonucleotide
tcgagtacgg

SEQ ID NO: 2744 - DNA, 10 bp, Artificial Sequence
  Description of Artificial Sequence: Synthetic oligonucleotide
tcgagtaggg

SEQ ID NO: 2745 - DNA, 10 bp, Artificial Sequence
  Description of Artificial Sequence: Synthetic oligonucleotide
  modified_base (2)..(2): a, c, t, g, unknown or other
gngagtatgc

SEQ ID NO: 2746 - DNA, 10 bp, Artificial Sequence
  Description of Artificial Sequence: Synthetic oligonucleotide
  modified_base (2)..(2): a, c, t, g, unknown or other
gngagtaagg

SEQ ID NO: 2747 - DNA, 10 bp, Artificial Sequence
  Description of Artificial Sequence: Synthetic oligonucleotide
  modified_base (2)..(2): a, c, t, g, unknown or other
gngagtacgg

SEQ ID NO: 2748 - DNA, 10 bp, Artificial Sequence
  Description of Artificial Sequence: Synthetic oligonucleotide
  modified_base (2)..(2): a, c, t, g, unknown or other
gngagtaggg

SEQ ID NO: 2749 - DNA, 10 bp, Artificial Sequence
  Description of Artificial Sequence: Synthetic oligonucleotide
  modified_base (1)..(1): a, c, t, g, unknown or other
nggagtatgc

SEQ ID NO: 2750 - DNA, 10 bp, Artificial Sequence
  Description of Artificial Sequence: Synthetic oligonucleotide
  modified_base (1)..(1): a, c, t, g, unknown or other
nggagtaagg

SEQ ID NO: 2751 - DNA, 10 bp, Artificial Sequence
  Description of Artificial Sequence: Synthetic oligonucleotide
  modified_base (1)..(1): a, c, t, g, unknown or other
nggagtacgg

SEQ ID NO: 2752 - DNA, 10 bp, Artificial Sequence
  Description of Artificial Sequence: Synthetic oligonucleotide
  modified_base (1)..(1): a, c, t, g, unknown or other
nggagtaggg

SEQ ID NO: 2753 - DNA, 10 bp, Artificial Sequence
  Description of Artificial Sequence: Synthetic oligonucleotide
aggagtatgc

SEQ ID NO: 2754 - DNA, 10 bp, Artificial Sequence
  Description of Artificial Sequence: Synthetic oligonucleotide
aggagtaagg

SEQ ID NO: 2755 - DNA, 10 bp, Artificial Sequence
  Description of Artificial Sequence: Synthetic oligonucleotide
aggagtacgg

SEQ ID NO: 2756 - DNA, 10 bp, Artificial Sequence
  Description of Artificial Sequence: Synthetic oligonucleotide
aggagtaggg

SEQ ID NO: 2757 - DNA, 10 bp, Artificial Sequence
  Description of Artificial Sequence: Synthetic oligonucleotide
cggagtatgc

SEQ ID NO: 2758 - DNA, 10 bp, Artificial Sequence
  Description of Artificial Sequence: Synthetic oligonucleotide
cggagtaagg

SEQ ID NO: 2759 - DNA, 10 bp, Artificial Sequence
  Description of Artificial Sequence: Synthetic oligonucleotide
cggagtacgg

SEQ ID NO: 2760 - DNA, 10 bp, Artificial Sequence
  Description of Artificial Sequence: Synthetic oligonucleotide
cggagtaggg

SEQ ID NO: 2761 - DNA, 10 bp, Artificial Sequence
  Description of Artificial Sequence: Synthetic oligonucleotide
gggagtatgc

SEQ ID NO: 2762 - DNA, 10 bp, Artificial Sequence
  Description of Artificial Sequence: Synthetic oligonucleotide
gggagtaagg

SEQ ID NO: 2763 - DNA, 10 bp, Artificial Sequence
  Description of Artificial Sequence: Synthetic oligonucleotide
gggagtacgg

SEQ ID NO: 2764 - DNA, 10 bp, Artificial Sequence
  Description of Artificial Sequence: Synthetic oligonucleotide
gggagtaggg

SEQ ID NO: 2765 - DNA, 10 bp, Artificial Sequence
  Description of Artificial Sequence: Synthetic oligonucleotide
tggagtatgc

SEQ ID NO: 2766 - DNA, 10 bp, Artificial Sequence
  Description of Artificial Sequence: Synthetic oligonucleotide
tggagtaagg

SEQ ID NO: 2767 - DNA, 10 bp, Artificial Sequence
  Description of Artificial Sequence: Synthetic oligonucleotide
tggagtacgg

SEQ ID NO: 2768 - DNA, 10 bp, Artificial Sequence
  Description of Artificial Sequence: Synthetic oligonucleotide
tggagtaggg

SEQ ID NO: 2769 - DNA, 10 bp, Artificial Sequence
  Description of Artificial Sequence: Synthetic oligonucleotide
  modified_base (2)..(2): a, c, t, g, unknown or other
tngagtatgc

SEQ ID NO: 2770 - DNA, 10 bp, Artificial Sequence
  Description of Artificial Sequence: Synthetic oligonucleotide
  modified_base (2)..(2): a, c, t, g, unknown or other
tngagtaagg

SEQ ID NO: 2771 - DNA, 10 bp, Artificial Sequence
  Description of Artificial Sequence: Synthetic oligonucleotide
  modified_base (2)..(2): a, c, t, g, unknown or other
tngagtacgg

SEQ ID NO: 2772 - DNA, 10 bp, Artificial Sequence
  Description of Artificial Sequence: Synthetic oligonucleotide
  modified_base (2)..(2): a, c, t, g, unknown or other
tngagtaggg

SEQ ID NO: 2773 - DNA, 10 bp, Artificial Sequence
  Description of Artificial Sequence: Synthetic oligonucleotide
  modified_base (1)..(1): a, c, t, g, unknown or other
ntgagtatgc

SEQ ID NO: 2774 - DNA, 10 bp, Artificial Sequence
  Description of Artificial Sequence: Synthetic oligonucleotide
  modified_base (1)..(1): a, c, t, g, unknown or other
ntgagtaagg

SEQ ID NO: 2775 - DNA, 10 bp, Artificial Sequence
  Description of Artificial Sequence: Synthetic oligonucleotide
  modified_base (1)..(1): a, c, t, g, unknown or other
ntgagtacgg

SEQ ID NO: 2776 - DNA, 10 bp, Artificial Sequence
  Description of Artificial Sequence: Synthetic oligonucleotide
  modified_base (1)..(1): a, c, t, g, unknown or other
ntgagtaggg

SEQ ID NO: 2777 - DNA, 10 bp, Artificial Sequence
  Description of Artificial Sequence: Synthetic oligonucleotide
atgagtatgc

SEQ ID NO: 2778 - DNA, 10 bp, Artificial Sequence
  Description of Artificial Sequence: Synthetic oligonucleotide
atgagtaagg

SEQ ID NO: 2779 - DNA, 10 bp, Artificial Sequence
  Description of Artificial Sequence: Synthetic oligonucleotide
atgagtacgg

SEQ ID NO: 2780 - DNA, 10 bp, Artificial Sequence
  Description of Artificial Sequence: Synthetic oligonucleotide
atgagtaggg

SEQ ID NO: 2781 - DNA, 10 bp, Artificial Sequence
  Description of Artificial Sequence: Synthetic oligonucleotide
ctgagtatgc

SEQ ID NO: 2782 - DNA, 10 bp, Artificial Sequence
  Description of Artificial Sequence: Synthetic oligonucleotide
ctgagtaagg

SEQ ID NO: 2783 - DNA, 10 bp, Artificial Sequence
  Description of Artificial Sequence: Synthetic oligonucleotide
ctgagtacgg

SEQ ID NO: 2784 - DNA, 10 bp, Artificial Sequence
  Description of Artificial Sequence: Synthetic oligonucleotide
ctgagtaggg

SEQ ID NO: 2785 - DNA, 10 bp, Artificial Sequence
  Description of Artificial Sequence: Synthetic oligonucleotide
gtgagtatgc

SEQ ID NO: 2786 - DNA, 10 bp, Artificial Sequence
  Description of Artificial Sequence: Synthetic oligonucleotide
gtgagtaagg

SEQ ID NO: 2787 - DNA, 10 bp, Artificial Sequence
  Description of Artificial Sequence: Synthetic oligonucleotide
gtgagtacgg

SEQ ID NO: 2788 - DNA, 10 bp, Artificial Sequence
  Description of Artificial Sequence: Synthetic oligonucleotide
gtgagtaggg

SEQ ID NO: 2789 - DNA, 10 bp, Artificial Sequence
  Description of Artificial Sequence: Synthetic oligonucleotide
ttgagtatgc

SEQ ID NO: 2790 - DNA, 10 bp, Artificial Sequence
  Description of Artificial Sequence: Synthetic oligonucleotide
ttgagtaagg

SEQ ID NO: 2791 - DNA, 10 bp, Artificial Sequence
  Description of Artificial Sequence: Synthetic oligonucleotide
ttgagtacgg

SEQ ID NO: 2792 - DNA, 10 bp, Artificial Sequence
  Description of Artificial Sequence: Synthetic oligonucleotide
ttgagtaggg

SEQ ID NO: 2793 - DNA, 10 bp, Artificial Sequence
  Description of Artificial Sequence: Synthetic oligonucleotide
  modified_base (2)..(2): a, c, t, g, unknown or other
angagtatgg

SEQ ID NO: 2794 - DNA, 10 bp, Artificial Sequence
  Description of Artificial Sequence: Synthetic oligonucleotide
  modified_base (2)..(2): a, c, t, g, unknown or other
angagtaagt

SEQ ID NO: 2795 - DNA, 10 bp, Artificial Sequence
  Description of Artificial Sequence: Synthetic oligonucleotide
  modified_base (2)..(2): a, c, t, g, unknown or other
angagtacgt

SEQ ID NO: 2796 - DNA, 10 bp, Artificial Sequence
  Description of Artificial Sequence: Synthetic oligonucleotide
  modified_base (2)..(2): a, c, t, g, unknown or other
angagtaggt

SEQ ID NO: 2797 - DNA, 10 bp, Artificial Sequence
  Description of Artificial Sequence: Synthetic oligonucleotide
  modified_base (1)..(1): a, c, t, g, unknown or other
nagagtatgg

SEQ ID NO: 2798 - DNA, 10 bp, Artificial Sequence
  Description of Artificial Sequence: Synthetic oligonucleotide
  modified_base (1)..(1): a, c, t, g, unknown or other
nagagtaagt

SEQ ID NO: 2799 - DNA, 10 bp, Artificial Sequence
  Description of Artificial Sequence: Synthetic oligonucleotide
  modified_base (1)..(1): a, c, t, g, unknown or other
nagagtacgt

SEQ ID NO: 2800 - DNA, 10 bp, Artificial Sequence
  Description of Artificial Sequence: Synthetic oligonucleotide
  modified_base (1)..(1): a, c, t, g, unknown or other
nagagtaggt

SEQ ID NO: 2801 - DNA, 10 bp, Artificial Sequence
  Description of Artificial Sequence: Synthetic oligonucleotide
aagagtatgg

SEQ ID NO: 2802 - DNA, 10 bp, Artificial Sequence
  Description of Artificial Sequence: Synthetic oligonucleotide
aagagtaagt

SEQ ID NO: 2803 - DNA, 10 bp, Artificial Sequence
  Description of Artificial Sequence: Synthetic oligonucleotide
aagagtacgt

SEQ ID NO: 2804 - DNA, 10 bp, Artificial Sequence
  Description of Artificial Sequence: Synthetic oligonucleotide
aagagtaggt

SEQ ID NO: 2805 - DNA, 10 bp, Artificial Sequence
  Description of Artificial Sequence: Synthetic oligonucleotide
cagagtatgg

SEQ ID NO: 2806 - DNA, 10 bp, Artificial Sequence
  Description of Artificial Sequence: Synthetic oligonucleotide
cagagtaagt

SEQ ID NO: 2807 - DNA, 10 bp, Artificial Sequence
  Description of Artificial Sequence: Synthetic oligonucleotide
cagagtacgt

SEQ ID NO: 2808 - DNA, 10 bp, Artificial Sequence
  Description of Artificial Sequence: Synthetic oligonucleotide
cagagtaggt

SEQ ID NO: 2809 - DNA, 10 bp, Artificial Sequence
  Description of Artificial Sequence: Synthetic oligonucleotide
gagagtatgg

SEQ ID NO: 2810 - DNA, 10 bp, Artificial Sequence
  Description of Artificial Sequence: Synthetic oligonucleotide
gagagtaagt

SEQ ID NO: 2811 - DNA, 10 bp, Artificial Sequence
  Description of Artificial Sequence: Synthetic oligonucleotide
gagagtacgt

SEQ ID NO: 2812 - DNA, 10 bp, Artificial Sequence
  Description of Artificial Sequence: Synthetic oligonucleotide
gagagtaggt

SEQ ID NO: 2813 - DNA, 10 bp, Artificial Sequence
  Description of Artificial Sequence: Synthetic oligonucleotide
tagagtatgg

SEQ ID NO: 2814 - DNA, 10 bp, Artificial Sequence
  Description of Artificial Sequence: Synthetic oligonucleotide
tagagtaagt

SEQ ID NO: 2815 - DNA, 10 bp, Artificial Sequence
  Description of Artificial Sequence: Synthetic oligonucleotide
tagagtacgt

SEQ ID NO: 2816 - DNA, 10 bp, Artificial Sequence
  Description of Artificial Sequence: Synthetic oligonucleotide
tagagtaggt

SEQ ID NO: 2817 - DNA, 10 bp, Artificial Sequence
  Description of Artificial Sequence: Synthetic oligonucleotide
  modified_base (2)..(2): a, c, t, g, unknown or other
cngagtatgg

SEQ ID NO: 2818 - DNA, 10 bp, Artificial Sequence
  Description of Artificial Sequence: Synthetic oligonucleotide
  modified_base (2)..(2): a, c, t, g, unknown or other
cngagtaagt

SEQ ID NO: 2819 - DNA, 10 bp, Artificial Sequence
  Description of Artificial Sequence: Synthetic oligonucleotide
  modified_base (2)..(2): a, c, t, g, unknown or other
cngagtacgt

SEQ ID NO: 2820 - DNA, 10 bp, Artificial Sequence
  Description of Artificial Sequence: Synthetic oligonucleotide
  modified_base (2)..(2): a, c, t, g, unknown or other
cngagtaggt

SEQ ID NO: 2821 - DNA, 10 bp, Artificial Sequence
  Description of Artificial Sequence: Synthetic oligonucleotide
  modified_base (1)..(1): a, c, t, g, unknown or other
ncgagtatgg

SEQ ID NO: 2822 - DNA, 10 bp, Artificial Sequence
  Description of Artificial Sequence: Synthetic oligonucleotide
  modified_base (1)..(1): a, c, t, g, unknown or other
ncgagtaagt

SEQ ID NO: 2823 - DNA, 10 bp, Artificial Sequence
  Description of Artificial Sequence: Synthetic oligonucleotide
  modified_base (1)..(1): a, c, t, g, unknown or other
ncgagtacgt

SEQ ID NO: 2824 - DNA, 10 bp, Artificial Sequence
  Description of Artificial Sequence: Synthetic oligonucleotide
  modified_base (1)..(1): a, c, t, g, unknown or other
ncgagtaggt

SEQ ID NO: 2825 - DNA, 10 bp, Artificial Sequence
  Description of Artificial Sequence: Synthetic oligonucleotide
acgagtatgg

SEQ ID NO: 2826 - DNA, 10 bp, Artificial Sequence
  Description of Artificial Sequence: Synthetic oligonucleotide
acgagtaagt

SEQ ID NO: 2827 - DNA, 10 bp, Artificial Sequence
  Description of Artificial Sequence: Synthetic oligonucleotide
acgagtacgt

SEQ ID NO: 2828 - DNA, 10 bp, Artificial Sequence
  Description of Artificial Sequence: Synthetic oligonucleotide
acgagtaggt

SEQ ID NO: 2829 - DNA, 10 bp, Artificial Sequence
  Description of Artificial Sequence: Synthetic oligonucleotide
ccgagtatgg

SEQ ID NO: 2830 - DNA, 10 bp, Artificial Sequence
  Description of Artificial Sequence: Synthetic oligonucleotide
ccgagtaagt

SEQ ID NO: 2831 - DNA, 10 bp, Artificial Sequence
  Description of Artificial Sequence: Synthetic oligonucleotide
ccgagtacgt

SEQ ID NO: 2832 - DNA, 10 bp, Artificial Sequence
  Description of Artificial Sequence: Synthetic oligonucleotide
ccgagtaggt

SEQ ID NO: 2833 - DNA, 10 bp, Artificial Sequence
  Description of Artificial Sequence: Synthetic oligonucleotide
gcgagtatgg

SEQ ID NO: 2834 - DNA, 10 bp, Artificial Sequence
  Description of Artificial Sequence: Synthetic oligonucleotide
gcgagtaagt

SEQ ID NO: 2835 - DNA, 10 bp, Artificial Sequence
  Description of Artificial Sequence: Synthetic oligonucleotide
gcgagtacgt

SEQ ID NO: 2836 - DNA, 10 bp, Artificial Sequence
  Description of Artificial Sequence: Synthetic oligonucleotide
gcgagtaggt

SEQ ID NO: 2837 - DNA, 10 bp, Artificial Sequence
  Description of Artificial Sequence: Synthetic oligonucleotide
tcgagtatgg

SEQ ID NO: 2838 - DNA, 10 bp, Artificial Sequence
  Description of Artificial Sequence: Synthetic oligonucleotide
tcgagtaagt

SEQ ID NO: 2839 - DNA, 10 bp, Artificial Sequence
  Description of Artificial Sequence: Synthetic oligonucleotide
tcgagtacgt

SEQ ID NO: 2840 - DNA, 10 bp, Artificial Sequence
  Description of Artificial Sequence: Synthetic oligonucleotide
tcgagtaggt

SEQ ID NO: 2841 - DNA, 10 bp, Artificial Sequence
  Description of Artificial Sequence: Synthetic oligonucleotide
  modified_base (2)..(2): a, c, t, g, unknown or other
gngagtatgg

SEQ ID NO: 2842 - DNA, 10 bp, Artificial Sequence
  Description of Artificial Sequence: Synthetic oligonucleotide
  modified_base (2)..(2): a, c, t, g, unknown or other
gngagtaagt

SEQ ID NO: 2843 - DNA, 10 bp, Artificial Sequence
  Description of Artificial Sequence: Synthetic oligonucleotide
  modified_base (2)..(2): a, c, t, g, unknown or other
gngagtacgt

SEQ ID NO: 2844 - DNA, 10 bp, Artificial Sequence
  Description of Artificial Sequence: Synthetic oligonucleotide
  modified_base (2)..(2): a, c, t, g, unknown or other
gngagtaggt

SEQ ID NO: 2845 - DNA, 10 bp, Artificial Sequence
  Description of Artificial Sequence: Synthetic oligonucleotide
  modified_base (1)..(1): a, c, t, g, unknown or other
nggagtatgg

SEQ ID NO: 2846 - DNA, 10 bp, Artificial Sequence
  Description of Artificial Sequence: Synthetic oligonucleotide
  modified_base (1)..(1): a, c, t, g, unknown or other
nggagtaagt

SEQ ID NO: 2847 - DNA, 10 bp, Artificial Sequence
  Description of Artificial Sequence: Synthetic oligonucleotide
  modified_base (1)..(1): a, c, t, g, unknown or other
nggagtacgt

SEQ ID NO: 2848 - DNA, 10 bp, Artificial Sequence
  Description of Artificial Sequence: Synthetic oligonucleotide
  modified_base (1)..(1): a, c, t, g, unknown or other
nggagtaggt

SEQ ID NO: 2849 - DNA, 10 bp, Artificial Sequence
  Description of Artificial Sequence: Synthetic oligonucleotide
aggagtatgg

SEQ ID NO: 2850 - DNA, 10 bp, Artificial Sequence
  Description of Artificial Sequence: Synthetic oligonucleotide
aggagtaagt

SEQ ID NO: 2851 - DNA, 10 bp, Artificial Sequence
  Description of Artificial Sequence: Synthetic oligonucleotide
aggagtacgt

SEQ ID NO: 2852 - DNA, 10 bp, Artificial Sequence
  Description of Artificial Sequence: Synthetic oligonucleotide
aggagtaggt

SEQ ID NO: 2853 - DNA, 10 bp, Artificial Sequence
  Description of Artificial Sequence: Synthetic oligonucleotide
cggagtatgg

SEQ ID NO: 2854 - DNA, 10 bp, Artificial Sequence
  Description of Artificial Sequence: Synthetic oligonucleotide
cggagtaagt

SEQ ID NO: 2855 - DNA, 10 bp, Artificial Sequence
  Description of Artificial Sequence: Synthetic oligonucleotide
cggagtacgt

SEQ ID NO: 2856 - DNA, 10 bp, Artificial Sequence
  Description of Artificial Sequence: Synthetic oligonucleotide
cggagtaggt

SEQ ID NO: 2857 - DNA, 10 bp, Artificial Sequence
  Description of Artificial Sequence: Synthetic oligonucleotide
gggagtatgg

SEQ ID NO: 2858 - DNA, 10 bp, Artificial Sequence
  Description of Artificial Sequence: Synthetic oligonucleotide
gggagtaagt

SEQ ID NO: 2859 - DNA, 10 bp, Artificial Sequence
  Description of Artificial Sequence: Synthetic oligonucleotide
gggagtacgt

SEQ ID NO: 2860 - DNA, 10 bp, Artificial Sequence
  Description of Artificial Sequence: Synthetic oligonucleotide
gggagtaggt

SEQ ID NO: 2861 - DNA, 10 bp, Artificial Sequence
  Description of Artificial Sequence: Synthetic oligonucleotide
tggagtatgg

SEQ ID NO: 2862 - DNA, 10 bp, Artificial Sequence
  Description of Artificial Sequence: Synthetic oligonucleotide
tggagtaagt

SEQ ID NO: 2863 - DNA, 10 bp, Artificial Sequence
  Description of Artificial Sequence: Synthetic oligonucleotide
tggagtacgt

SEQ ID NO: 2864 - DNA, 10 bp, Artificial Sequence
  Description of Artificial Sequence: Synthetic oligonucleotide
tggagtaggt

SEQ ID NO: 2865 - DNA, 10 bp, Artificial Sequence
  Description of Artificial Sequence: Synthetic oligonucleotide
  modified_base (2)..(2): a, c, t, g, unknown or other
tngagtatgg

SEQ ID NO: 2866 - DNA, 10 bp, Artificial Sequence
  Description of Artificial Sequence: Synthetic oligonucleotide
  modified_base (2)..(2): a, c, t, g, unknown or other
tngagtaagt

SEQ ID NO: 2867 - DNA, 10 bp, Artificial Sequence
  Description of Artificial Sequence: Synthetic oligonucleotide
  modified_base (2)..(2): a, c, t, g, unknown or other
tngagtacgt

SEQ ID NO: 2868 - DNA, 10 bp, Artificial Sequence
  Description of Artificial Sequence: Synthetic oligonucleotide
  modified_base (2)..(2): a, c, t, g, unknown or other
tngagtaggt

SEQ ID NO: 2869 - DNA, 10 bp, Artificial Sequence
  Description of Artificial Sequence: Synthetic oligonucleotide
  modified_base (1)..(1): a, c, t, g, unknown or other
ntgagtatgg

SEQ ID NO: 2870 - DNA, 10 bp, Artificial Sequence
  Description of Artificial Sequence: Synthetic oligonucleotide
  modified_base (1)..(1): a, c, t, g, unknown or other
ntgagtaagt

SEQ ID NO: 2871 - DNA, 10 bp, Artificial Sequence
  Description of Artificial Sequence: Synthetic oligonucleotide
  modified_base (1)..(1): a, c, t, g, unknown or other
ntgagtacgt

SEQ ID NO: 2872 - DNA, 10 bp, Artificial Sequence
  Description of Artificial Sequence: Synthetic oligonucleotide
  modified_base (1)..(1): a, c, t, g, unknown or other
ntgagtaggt

SEQ ID NO: 2873 - DNA, 10 bp, Artificial Sequence
  Description of Artificial Sequence: Synthetic oligonucleotide
atgagtatgg

SEQ ID NO: 2874 - DNA, 10 bp, Artificial Sequence
  Description of Artificial Sequence: Synthetic oligonucleotide
atgagtaagt

SEQ ID NO: 2875 - DNA, 10 bp, Artificial Sequence
  Description of Artificial Sequence: Synthetic oligonucleotide
atgagtacgt

SEQ ID NO: 2876 - DNA, 10 bp, Artificial Sequence
  Description of Artificial Sequence: Synthetic oligonucleotide
atgagtaggt

SEQ ID NO: 2877 - DNA, 10 bp, Artificial Sequence
  Description of Artificial Sequence: Synthetic oligonucleotide
ctgagtatgg

SEQ ID NO: 2878 - DNA, 10 bp, Artificial Sequence
  Description of Artificial Sequence: Synthetic oligonucleotide
ctgagtaagt

SEQ ID NO: 2879 - DNA, 10 bp, Artificial Sequence
  Description of Artificial Sequence: Synthetic oligonucleotide
ctgagtacgt

SEQ ID NO: 2880 - DNA, 10 bp, Artificial Sequence
  Description of Artificial Sequence: Synthetic oligonucleotide
ctgagtaggt

SEQ ID NO: 2881 - DNA, 10 bp, Artificial Sequence
  Description of Artificial Sequence: Synthetic oligonucleotide
gtgagtatgg

SEQ ID NO: 2882 - DNA, 10 bp, Artificial Sequence
  Description of Artificial Sequence: Synthetic oligonucleotide
gtgagtaagt

SEQ ID NO: 2883 - DNA, 10 bp, Artificial Sequence
  Description of Artificial Sequence: Synthetic oligonucleotide
gtgagtacgt

SEQ ID NO: 2884 - DNA, 10 bp, Artificial Sequence
  Description of Artificial Sequence: Synthetic oligonucleotide
gtgagtaggt

SEQ ID NO: 2885 - DNA, 10 bp, Artificial Sequence
  Description of Artificial Sequence: Synthetic oligonucleotide
ttgagtatgg

SEQ ID NO: 2886 - DNA, 10 bp, Artificial Sequence
  Description of Artificial Sequence: Synthetic oligonucleotide
ttgagtaagt

SEQ ID NO: 2887 - DNA, 10 bp, Artificial Sequence
  Description of Artificial Sequence: Synthetic oligonucleotide
ttgagtacgt

SEQ ID NO: 2888 - DNA, 10 bp, Artificial Sequence
  Description of Artificial Sequence: Synthetic oligonucleotide
ttgagtaggt

SEQ ID NO: 2889 - DNA, 10 bp, Artificial Sequence
  Description of Artificial Sequence: Synthetic oligonucleotide
  modified_base (2)..(2): a, c, t, g, unknown or other
angagtatgt

SEQ ID NO: 2890 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
angagtanga

SEQ ID NO: 2891 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
angagtangc

SEQ ID NO: 2892 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
angagtangg

SEQ ID NO: 2893 - DNA, 10 bp, Artificial Sequence
  Description of Artificial Sequence: Synthetic oligonucleotide
  modified_base (1)..(1): a, c, t, g, unknown or other
nagagtatgt

SEQ ID NO: 2894 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
nagagtanga

SEQ ID NO: 2895 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
nagagtangc

SEQ ID NO: 2896 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
nagagtangg

SEQ ID NO: 2897 - DNA, 10 bp, Artificial Sequence
  Description of Artificial Sequence: Synthetic oligonucleotide
aagagtatgt

SEQ ID NO: 2898 - DNA, 10 bp, Artificial Sequence
  Description of Artificial Sequence: Synthetic oligonucleotide
  modified_base (8)..(8): a, c, t, g, unknown or other
aagagtanga

SEQ ID NO: 2899 - DNA, 10 bp, Artificial Sequence
  Description of Artificial Sequence: Synthetic oligonucleotide
  modified_base (8)..(8): a, c, t, g, unknown or other
aagagtangc

SEQ ID NO: 2900 - DNA, 10 bp, Artificial Sequence
  Description of Artificial Sequence: Synthetic oligonucleotide
  modified_base (8)..(8): a, c, t, g, unknown or other
aagagtangg

SEQ ID NO: 2901 - DNA, 10 bp, Artificial Sequence
  Description of Artificial Sequence: Synthetic oligonucleotide
cagagtatgt

SEQ ID NO: 2902 - DNA, 10 bp, Artificial Sequence
  Description of Artificial Sequence: Synthetic oligonucleotide
  modified_base (8)..(8): a, c, t, g, unknown or other
cagagtanga

SEQ ID NO: 2903 - DNA, 10 bp, Artificial Sequence
  Description of Artificial Sequence: Synthetic oligonucleotide
  modified_base (8)..(8): a, c, t, g, unknown or other
cagagtangc

SEQ ID NO: 2904 - DNA, 10 bp, Artificial Sequence
  Description of Artificial Sequence: Synthetic oligonucleotide
  modified_base (8)..(8): a, c, t, g, unknown or other
cagagtangg

SEQ ID NO: 2905 - DNA, 10 bp, Artificial Sequence
  Description of Artificial Sequence: Synthetic oligonucleotide
gagagtatgt

SEQ ID NO: 2906 - DNA, 10 bp, Artificial Sequence
  Description of Artificial Sequence: Synthetic oligonucleotide
  modified_base (8)..(8): a, c, t, g, unknown or other
gagagtanga

SEQ ID NO: 2907 - DNA, 10 bp, Artificial Sequence
  Description of Artificial Sequence: Synthetic oligonucleotide
  modified_base (8)..(8): a, c, t, g, unknown or other
gagagtangc

SEQ ID NO: 2908 - DNA, 10 bp, Artificial Sequence
  Description of Artificial Sequence: Synthetic oligonucleotide
  modified_base (8)..(8): a, c, t, g, unknown or other
gagagtangg

SEQ ID NO: 2909 - DNA, 10 bp, Artificial Sequence
  Description of Artificial Sequence: Synthetic oligonucleotide
tagagtatgt

SEQ ID NO: 2910 - DNA, 10 bp, Artificial Sequence
  Description of Artificial Sequence: Synthetic oligonucleotide
  modified_base (8)..(8): a, c, t, g, unknown or other
tagagtanga

SEQ ID NO: 2911 - DNA, 10 bp, Artificial Sequence
  Description of Artificial Sequence: Synthetic oligonucleotide
  modified_base (8)..(8): a, c, t, g, unknown or other
tagagtangc

SEQ ID NO: 2912 - DNA, 10 bp, Artificial Sequence
  Description of Artificial Sequence: Synthetic oligonucleotide
  modified_base (8)..(8): a, c, t, g, unknown or other
tagagtangg

SEQ ID NO: 2913 - DNA, 10 bp, Artificial Sequence
  Description of Artificial Sequence: Synthetic oligonucleotide
  modified_base (2)..(2): a, c, t, g, unknown or other
cngagtatgt

SEQ ID NO: 2914 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
cngagtanga

SEQ ID NO: 2915 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
cngagtangc

SEQ ID NO: 2916 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
cngagtangg

SEQ ID NO: 2917 - DNA, 10 bp, Artificial Sequence
  Description of Artificial Sequence: Synthetic oligonucleotide
  modified_base (1)..(1): a, c, t, g, unknown or other
ncgagtatgt

SEQ ID NO: 2918 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
ncgagtanga

SEQ ID NO: 2919 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
ncgagtangc

SEQ ID NO: 2920 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
ncgagtangg

SEQ ID NO: 2921 - DNA, 10 bp, Artificial Sequence
  Description of Artificial Sequence: Synthetic oligonucleotide
acgagtatgt

SEQ ID NO: 2922 - DNA, 10 bp, Artificial Sequence
  Description of Artificial Sequence: Synthetic oligonucleotide
  modified_base (8)..(8): a, c, t, g, unknown or other
acgagtanga

SEQ ID NO: 2923 - DNA, 10 bp, Artificial Sequence
  Description of Artificial Sequence: Synthetic oligonucleotide
  modified_base (8)..(8): a, c, t, g, unknown or other
acgagtangc

SEQ ID NO: 2924 - DNA, 10 bp, Artificial Sequence
  Description of Artificial Sequence: Synthetic oligonucleotide
  modified_base (8)..(8): a, c, t, g, unknown or other
acgagtangg

SEQ ID NO: 2925 - DNA, 10 bp, Artificial Sequence
  Description of Artificial Sequence: Synthetic oligonucleotide
ccgagtatgt

SEQ ID NO: 2926 - DNA, 10 bp, Artificial Sequence
  Description of Artificial Sequence: Synthetic oligonucleotide
  modified_base (8)..(8): a, c, t, g, unknown or other
ccgagtanga

SEQ ID NO: 2927 - DNA, 10 bp, Artificial Sequence
  Description of Artificial Sequence: Synthetic oligonucleotide
  modified_base (8)..(8): a, c, t, g, unknown or other
ccgagtangc

SEQ ID NO: 2928 - DNA, 10 bp, Artificial Sequence
  Description of Artificial Sequence: Synthetic oligonucleotide
  modified_base (8)..(8): a, c, t, g, unknown or other
ccgagtangg

SEQ ID NO: 2929 - DNA, 10 bp, Artificial Sequence
  Description of Artificial Sequence: Synthetic oligonucleotide
gcgagtatgt

SEQ ID NO: 2930 - DNA, 10 bp, Artificial Sequence
  Description of Artificial Sequence: Synthetic oligonucleotide
  modified_base (8)..(8): a, c, t, g, unknown or other
gcgagtanga

SEQ ID NO: 2931 - DNA, 10 bp, Artificial Sequence
  Description of Artificial Sequence: Synthetic oligonucleotide
  modified_base (8)..(8): a, c, t, g, unknown or other
gcgagtangc

SEQ ID NO: 2932 - DNA, 10 bp, Artificial Sequence
  Description of Artificial Sequence: Synthetic oligonucleotide
  modified_base (8)..(8): a, c, t, g, unknown or other
gcgagtangg

SEQ ID NO: 2933 - DNA, 10 bp, Artificial Sequence
  Description of Artificial Sequence: Synthetic oligonucleotide
tcgagtatgt

SEQ ID NO: 2934 - DNA, 10 bp, Artificial Sequence
  Description of Artificial Sequence: Synthetic oligonucleotide
  modified_base (8)..(8): a, c, t, g, unknown or other
tcgagtanga

SEQ ID NO: 2935 - DNA, 10 bp, Artificial Sequence
  Description of Artificial Sequence: Synthetic oligonucleotide
  modified_base (8)..(8): a, c, t, g, unknown or other
tcgagtangc

SEQ ID NO: 2936 - DNA, 10 bp, Artificial Sequence
  Description of Artificial Sequence: Synthetic oligonucleotide
  modified_base (8)..(8): a, c, t, g, unknown or other
tcgagtangg

SEQ ID NO: 2937 - DNA, 10 bp, Artificial Sequence
  Description of Artificial Sequence: Synthetic oligonucleotide
  modified_base (2)..(2): a, c, t, g, unknown or other
gngagtatgt

SEQ ID NO: 2938 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
gngagtanga

SEQ ID NO: 2939 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
gngagtangc

SEQ ID NO: 2940 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
gngagtangg

SEQ ID NO: 2941 - DNA, 10 bp, Artificial Sequence
  Description of Artificial Sequence: Synthetic oligonucleotide
  modified_base (1)..(1): a, c, t, g, unknown or other
nggagtatgt

SEQ ID NO: 2942 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
nggagtanga

SEQ ID NO: 2943 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
nggagtangc

SEQ ID NO: 2944 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
nggagtangg

SEQ ID NO: 2945 - DNA, 10 bp, Artificial Sequence
  Description of Artificial Sequence: Synthetic oligonucleotide
aggagtatgt

SEQ ID NO: 2946 - DNA, 10 bp, Artificial Sequence
  Description of Artificial Sequence: Synthetic oligonucleotide
  modified_base (8)..(8): a, c, t, g, unknown or other
aggagtanga

SEQ ID NO: 2947 - DNA, 10 bp, Artificial Sequence
  Description of Artificial Sequence: Synthetic oligonucleotide
  modified_base (8)..(8): a, c, t, g, unknown or other
aggagtangc

SEQ ID NO: 2948 - DNA, 10 bp, Artificial Sequence
  Description of Artificial Sequence: Synthetic oligonucleotide
  modified_base (8)..(8): a, c, t, g, unknown or other
aggagtangg

SEQ ID NO: 2949 - DNA, 10 bp, Artificial Sequence
  Description of Artificial Sequence: Synthetic oligonucleotide
cggagtatgt

SEQ ID NO: 2950 - DNA, 10 bp, Artificial Sequence
  Description of Artificial Sequence: Synthetic oligonucleotide
  modified_base (8)..(8): a, c, t, g, unknown or other
cggagtanga

SEQ ID NO: 2951 - DNA, 10 bp, Artificial Sequence
  Description of Artificial Sequence: Synthetic oligonucleotide
  modified_base (8)..(8): a, c, t, g, unknown or other
cggagtangc

SEQ ID NO: 2952 - DNA, 10 bp, Artificial Sequence
  Description of Artificial Sequence: Synthetic oligonucleotide
  modified_base (8)..(8): a, c, t, g, unknown or other
cggagtangg

SEQ ID NO: 2953 - DNA, 10 bp, Artificial Sequence
  Description of Artificial Sequence: Synthetic oligonucleotide
gggagtatgt

SEQ ID NO: 2954 - DNA, 10 bp, Artificial Sequence
  Description of Artificial Sequence: Synthetic oligonucleotide
  modified_base (8)..(8): a, c, t, g, unknown or other
gggagtanga

SEQ ID NO: 2955 - DNA, 10 bp, Artificial Sequence
  Description of Artificial Sequence: Synthetic oligonucleotide
  modified_base (8)..(8): a, c, t, g, unknown or other
gggagtangc

SEQ ID NO: 2956 - DNA, 10 bp, Artificial Sequence
  Description of Artificial Sequence: Synthetic oligonucleotide
  modified_base (8)..(8): a, c, t, g, unknown or other
gggagtangg

SEQ ID NO: 2957 - DNA, 10 bp, Artificial Sequence
  Description of Artificial Sequence: Synthetic oligonucleotide
tggagtatgt

SEQ ID NO: 2958 - DNA, 10 bp, Artificial Sequence
  Description of Artificial Sequence: Synthetic oligonucleotide
  modified_base (8)..(8): a, c, t, g, unknown or other
tggagtanga

SEQ ID NO: 2959 - DNA, 10 bp, Artificial Sequence
  Description of Artificial Sequence: Synthetic oligonucleotide
  modified_base (8)..(8): a, c, t, g, unknown or other
tggagtangc

SEQ ID NO: 2960 - DNA, 10 bp, Artificial Sequence
  Description of Artificial Sequence: Synthetic oligonucleotide
  modified_base (8)..(8): a, c, t, g, unknown or other
tggagtangg

SEQ ID NO: 2961 - DNA, 10 bp, Artificial Sequence
  Description of Artificial Sequence: Synthetic oligonucleotide
  modified_base (2)..(2): a, c, t, g, unknown or other
tngagtatgt

SEQ ID NO: 2962 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
tngagtanga

SEQ ID NO: 2963 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
tngagtangc

SEQ ID NO: 2964 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
tngagtangg

SEQ ID NO: 2965 - DNA, 10 bp, Artificial Sequence
  Description of Artificial Sequence: Synthetic oligonucleotide
  modified_base (1)..(1): a, c, t, g, unknown or other
ntgagtatgt

SEQ ID NO: 2966 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
ntgagtanga

SEQ ID NO: 2967 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
ntgagtangc

SEQ ID NO: 2968 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
ntgagtangg

SEQ ID NO: 2969 - DNA, 10 bp, Artificial Sequence
  Description of Artificial Sequence: Synthetic oligonucleotide
atgagtatgt

SEQ ID NO: 2970 - DNA, 10 bp, Artificial Sequence
  Description of Artificial Sequence: Synthetic oligonucleotide
  modified_base (8)..(8): a, c, t, g, unknown or other
atgagtanga

SEQ ID NO: 2971 - DNA, 10 bp, Artificial Sequence
  Description of Artificial Sequence: Synthetic oligonucleotide
  modified_base (8)..(8): a, c, t, g, unknown or other
atgagtangc

SEQ ID NO: 2972 - DNA, 10 bp, Artificial Sequence
  Description of Artificial Sequence: Synthetic oligonucleotide
  modified_base (8)..(8): a, c, t, g, unknown or other
atgagtangg

SEQ ID NO: 2973 - DNA, 10 bp, Artificial Sequence
  Description of Artificial Sequence: Synthetic oligonucleotide
ctgagtatgt

SEQ ID NO: 2974 - DNA, 10 bp, Artificial Sequence
  Description of Artificial Sequence: Synthetic oligonucleotide
  modified_base (8)..(8): a, c, t, g, unknown or other
ctgagtanga

SEQ ID NO: 2975 - DNA, 10 bp, Artificial Sequence
  Description of Artificial Sequence: Synthetic oligonucleotide
  modified_base (8)..(8): a, c, t, g, unknown or other
ctgagtangc

SEQ ID NO: 2976 - DNA, 10 bp, Artificial Sequence
  Description of Artificial Sequence: Synthetic oligonucleotide
  modified_base (8)..(8): a, c, t, g, unknown or other
ctgagtangg

SEQ ID NO: 2977 - DNA, 10 bp, Artificial Sequence
  Description of Artificial Sequence: Synthetic oligonucleotide
gtgagtatgt

SEQ ID NO: 2978 - DNA, 10 bp, Artificial Sequence
  Description of Artificial Sequence: Synthetic oligonucleotide
  modified_base (8)..(8): a, c, t, g, unknown or other
gtgagtanga

SEQ ID NO: 2979 - DNA, 10 bp, Artificial Sequence
  Description of Artificial Sequence: Synthetic oligonucleotide
  modified_base (8)..(8): a, c, t, g, unknown or other
gtgagtangc

SEQ ID NO: 2980 - DNA, 10 bp, Artificial Sequence
  Description of Artificial Sequence: Synthetic oligonucleotide
  modified_base (8)..(8): a, c, t, g, unknown or other
gtgagtangg

SEQ ID NO: 2981 - DNA, 10 bp, Artificial Sequence
  Description of Artificial Sequence: Synthetic oligonucleotide
ttgagtatgt

SEQ ID NO: 2982 - DNA, 10 bp, Artificial Sequence
  Description of Artificial Sequence: Synthetic oligonucleotide
  modified_base (8)..(8): a, c, t, g, unknown or other
ttgagtanga

SEQ ID NO: 2983 - DNA, 10 bp, Artificial Sequence
  Description of Artificial Sequence: Synthetic oligonucleotide
  modified_base (8)..(8): a, c, t, g, unknown or other
ttgagtangc

SEQ ID NO: 2984 - DNA, 10 bp, Artificial Sequence
  Description of Artificial Sequence: Synthetic oligonucleotide
  modified_base (8)..(8): a, c, t, g, unknown or other
ttgagtangg

SEQ ID NO: 2985 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
angagtangt

SEQ ID NO: 2986 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
  modified_base (10)..(10): a, c, t, g, unknown or other
angagtgngn

SEQ ID NO: 2987 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
angagtgagn

SEQ ID NO: 2988 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
angagtgcgn

SEQ ID NO: 2989 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
nagagtangt

SEQ ID NO: 2990 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
  modified_base (10)..(10): a, c, t, g, unknown or other
nagagtgngn

SEQ ID NO: 2991 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
nagagtgagn

SEQ ID NO: 2992 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
nagagtgcgn

SEQ ID NO: 2993 - DNA, 10 bp, Artificial Sequence
  Description of Artificial Sequence: Synthetic oligonucleotide
  modified_base (8)..(8): a, c, t, g, unknown or other
aagagtangt

SEQ ID NO: 2994 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
aagagtgngn

SEQ ID NO: 2995 - DNA, 10 bp, Artificial Sequence
  Description of Artificial Sequence: Synthetic oligonucleotide
  modified_base (10)..(10): a, c, t, g, unknown or other
aagagtgagn

SEQ ID NO: 2996 - DNA, 10 bp, Artificial Sequence
  Description of Artificial Sequence: Synthetic oligonucleotide
  modified_base (10)..(10): a, c, t, g, unknown or other
aagagtgcgn

SEQ ID NO: 2997 - DNA, 10 bp, Artificial Sequence
  Description of Artificial Sequence: Synthetic oligonucleotide
  modified_base (8)..(8): a, c, t, g, unknown or other
cagagtangt

SEQ ID NO: 2998 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
cagagtgngn

SEQ ID NO: 2999 - DNA, 10 bp, Artificial Sequence
  Description of Artificial Sequence: Synthetic oligonucleotide
  modified_base (10)..(10): a, c, t, g, unknown or other
cagagtgagn

SEQ ID NO: 3000 - DNA, 10 bp, Artificial Sequence
  Description of Artificial Sequence: Synthetic oligonucleotide
  modified_base (10)..(10): a, c, t, g, unknown or other
cagagtgcgn

SEQ ID NO: 3001 - DNA, 10 bp, Artificial Sequence
  Description of Artificial Sequence: Synthetic oligonucleotide
  modified_base (8)..(8): a, c, t, g, unknown or other
gagagtangt

SEQ ID NO: 3002 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
gagagtgngn

SEQ ID NO: 3003 - DNA, 10 bp, Artificial Sequence
  Description of Artificial Sequence: Synthetic oligonucleotide
  modified_base (10)..(10): a, c, t, g, unknown or other
gagagtgagn

SEQ ID NO: 3004 - DNA, 10 bp, Artificial Sequence
  Description of Artificial Sequence: Synthetic oligonucleotide
  modified_base (10)..(10): a, c, t, g, unknown or other
gagagtgcgn

SEQ ID NO: 3005 - DNA, 10 bp, Artificial Sequence
  Description of Artificial Sequence: Synthetic oligonucleotide
  modified_base (8)..(8): a, c, t, g, unknown or other
tagagtangt

SEQ ID NO: 3006 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
tagagtgngn

SEQ ID NO: 3007 - DNA, 10 bp, Artificial Sequence
  Description of Artificial Sequence: Synthetic oligonucleotide
  modified_base (10)..(10): a, c, t, g, unknown or other
tagagtgagn

SEQ ID NO: 3008 - DNA, 10 bp, Artificial Sequence
  Description of Artificial Sequence: Synthetic oligonucleotide
  modified_base (10)..(10): a, c, t, g, unknown or other
tagagtgcgn

SEQ ID NO: 3009 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
cngagtangt

SEQ ID NO: 3010 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
  modified_base (10)..(10): a, c, t, g, unknown or other
cngagtgngn

SEQ ID NO: 3011 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
cngagtgagn

SEQ ID NO: 3012 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
cngagtgcgn

SEQ ID NO: 3013 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
ncgagtangt

SEQ ID NO: 3014 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
  modified_base (10)..(10): a, c, t, g, unknown or other
ncgagtgngn

SEQ ID NO: 3015 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
ncgagtgagn

SEQ ID NO: 3016 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
ncgagtgcgn

SEQ ID NO: 3017 - DNA, 10 bp, Artificial Sequence
  Description of Artificial Sequence: Synthetic oligonucleotide
  modified_base (8)..(8): a, c, t, g, unknown or other
acgagtangt

SEQ ID NO: 3018 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
acgagtgngn

SEQ ID NO: 3019 - DNA, 10 bp, Artificial Sequence
  Description of Artificial Sequence: Synthetic oligonucleotide
  modified_base (10)..(10): a, c, t, g, unknown or other
acgagtgagn

SEQ ID NO: 3020 - DNA, 10 bp, Artificial Sequence
  Description of Artificial Sequence: Synthetic oligonucleotide
  modified_base (10)..(10): a, c, t, g, unknown or other
acgagtgcgn

SEQ ID NO: 3021 - DNA, 10 bp, Artificial Sequence
  Description of Artificial Sequence: Synthetic oligonucleotide
  modified_base (8)..(8): a, c, t, g, unknown or other
ccgagtangt

SEQ ID NO: 3022 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
ccgagtgngn

SEQ ID NO: 3023 - DNA, 10 bp, Artificial Sequence
  Description of Artificial Sequence: Synthetic oligonucleotide
  modified_base (10)..(10): a, c, t, g, unknown or other
ccgagtgagn

SEQ ID NO: 3024 - DNA, 10 bp, Artificial Sequence
  Description of Artificial Sequence: Synthetic oligonucleotide
  modified_base (10)..(10): a, c, t, g, unknown or other
ccgagtgcgn

SEQ ID NO: 3025 - DNA, 10 bp, Artificial Sequence
  Description of Artificial Sequence: Synthetic oligonucleotide
  modified_base (8)..(8): a, c, t, g, unknown or other
gcgagtangt

SEQ ID NO: 3026 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
gcgagtgngn

SEQ ID NO: 3027 - DNA, 10 bp, Artificial Sequence
  Description of Artificial Sequence: Synthetic oligonucleotide
  modified_base (10)..(10): a, c, t, g, unknown or other
gcgagtgagn

SEQ ID NO: 3028 - DNA, 10 bp, Artificial Sequence
  Description of Artificial Sequence: Synthetic oligonucleotide
  modified_base (10)..(10): a, c, t, g, unknown or other
gcgagtgcgn

SEQ ID NO: 3029 - DNA, 10 bp, Artificial Sequence
  Description of Artificial Sequence: Synthetic oligonucleotide
  modified_base (8)..(8): a, c, t, g, unknown or other
tcgagtangt

SEQ ID NO: 3030 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
tcgagtgngn

SEQ ID NO: 3031 - DNA, 10 bp, Artificial Sequence
  Description of Artificial Sequence: Synthetic oligonucleotide
  modified_base (10)..(10): a, c, t, g, unknown or other
tcgagtgagn

SEQ ID NO: 3032 - DNA, 10 bp, Artificial Sequence
  Description of Artificial Sequence: Synthetic oligonucleotide
  modified_base (10)..(10): a, c, t, g, unknown or other
tcgagtgcgn

SEQ ID NO: 3033 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
gngagtangt

SEQ ID NO: 3034 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
  modified_base (10)..(10): a, c, t, g, unknown or other
gngagtgngn

SEQ ID NO: 3035 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
gngagtgagn

SEQ ID NO: 3036 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
gngagtgcgn

SEQ ID NO: 3037 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
nggagtangt

SEQ ID NO: 3038 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
  modified_base (10)..(10): a, c, t, g, unknown or other
nggagtgngn

SEQ ID NO: 3039 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
nggagtgagn

SEQ ID NO: 3040 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
nggagtgcgn

SEQ ID NO: 3041 - DNA, 10 bp, Artificial Sequence
  Description of Artificial Sequence: Synthetic oligonucleotide
  modified_base (8)..(8): a, c, t, g, unknown or other
aggagtangt

SEQ ID NO: 3042 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
aggagtgngn

SEQ ID NO: 3043 - DNA, 10 bp, Artificial Sequence
  Description of Artificial Sequence: Synthetic oligonucleotide
  modified_base (10)..(10): a, c, t, g, unknown or other
aggagtgagn

SEQ ID NO: 3044 - DNA, 10 bp, Artificial Sequence
  Description of Artificial Sequence: Synthetic oligonucleotide
  modified_base (10)..(10): a, c, t, g, unknown or other
aggagtgcgn

SEQ ID NO: 3045 - DNA, 10 bp, Artificial Sequence
  Description of Artificial Sequence: Synthetic oligonucleotide
  modified_base (8)..(8): a, c, t, g, unknown or other
cggagtangt

SEQ ID NO: 3046 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
cggagtgngn

SEQ ID NO: 3047 - DNA, 10 bp, Artificial Sequence
  Description of Artificial Sequence: Synthetic oligonucleotide
  modified_base (10)..(10): a, c, t, g, unknown or other
cggagtgagn

SEQ ID NO: 3048 - DNA, 10 bp, Artificial Sequence
  Description of Artificial Sequence: Synthetic oligonucleotide
  modified_base (10)..(10): a, c, t, g, unknown or other
cggagtgcgn

SEQ ID NO: 3049 - DNA, 10 bp, Artificial Sequence
  Description of Artificial Sequence: Synthetic oligonucleotide
  modified_base (8)..(8): a, c, t, g, unknown or other
gggagtangt

SEQ ID NO: 3050 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
gggagtgngn

SEQ ID NO: 3051 - DNA, 10 bp, Artificial Sequence
  Description of Artificial Sequence: Synthetic oligonucleotide
  modified_base (10)..(10): a, c, t, g, unknown or other
gggagtgagn

SEQ ID NO: 3052 - DNA, 10 bp, Artificial Sequence
  Description of Artificial Sequence: Synthetic oligonucleotide
  modified_base (10)..(10): a, c, t, g, unknown or other
gggagtgcgn

SEQ ID NO: 3053 - DNA, 10 bp, Artificial Sequence
  Description of Artificial Sequence: Synthetic oligonucleotide
  modified_base (8)..(8): a, c, t, g, unknown or other
tggagtangt

SEQ ID NO: 3054 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
tggagtgngn

SEQ ID NO: 3055 - DNA, 10 bp, Artificial Sequence
  Description of Artificial Sequence: Synthetic oligonucleotide
  modified_base (10)..(10): a, c, t, g, unknown or other
tggagtgagn

SEQ ID NO: 3056 - DNA, 10 bp, Artificial Sequence
  Description of Artificial Sequence: Synthetic oligonucleotide
  modified_base (10)..(10): a, c, t, g, unknown or other
tggagtgcgn

SEQ ID NO: 3057 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
tngagtangt

SEQ ID NO: 3058 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
  modified_base (10)..(10): a, c, t, g, unknown or other
tngagtgngn

SEQ ID NO: 3059 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
tngagtgagn

SEQ ID NO: 3060 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
tngagtgcgn

SEQ ID NO: 3061 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
ntgagtangt

SEQ ID NO: 3062 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
  modified_base (10)..(10): a, c, t, g, unknown or other
ntgagtgngn

SEQ ID NO: 3063 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
ntgagtgagn

SEQ ID NO: 3064 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
ntgagtgcgn

SEQ ID NO: 3065 - DNA, 10 bp, Artificial Sequence
  Description of Artificial Sequence: Synthetic oligonucleotide
  modified_base (8)..(8): a, c, t, g, unknown or other
atgagtangt

SEQ ID NO: 3066 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
atgagtgngn

SEQ ID NO: 3067 - DNA, 10 bp, Artificial Sequence
  Description of Artificial Sequence: Synthetic oligonucleotide
  modified_base (10)..(10): a, c, t, g, unknown or other
atgagtgagn

SEQ ID NO: 3068 - DNA, 10 bp, Artificial Sequence
  Description of Artificial Sequence: Synthetic oligonucleotide
  modified_base (10)..(10): a, c, t, g, unknown or other
atgagtgcgn

SEQ ID NO: 3069 - DNA, 10 bp, Artificial Sequence
  Description of Artificial Sequence: Synthetic oligonucleotide
  modified_base (8)..(8): a, c, t, g, unknown or other
ctgagtangt

SEQ ID NO: 3070 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
ctgagtgngn

SEQ ID NO: 3071 - DNA, 10 bp, Artificial Sequence
  Description of Artificial Sequence: Synthetic oligonucleotide
  modified_base (10)..(10): a, c, t, g, unknown or other
ctgagtgagn

SEQ ID NO: 3072 - DNA, 10 bp, Artificial Sequence
  Description of Artificial Sequence: Synthetic oligonucleotide
  modified_base (10)..(10): a, c, t, g, unknown or other
ctgagtgcgn

SEQ ID NO: 3073 - DNA, 10 bp, Artificial Sequence
  Description of Artificial Sequence: Synthetic oligonucleotide
  modified_base (8)..(8): a, c, t, g, unknown or other
gtgagtangt

SEQ ID NO: 3074 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
gtgagtgngn

SEQ ID NO: 3075 - DNA, 10 bp, Artificial Sequence
  Description of Artificial Sequence: Synthetic oligonucleotide
  modified_base (10)..(10): a, c, t, g, unknown or other
gtgagtgagn

SEQ ID NO: 3076 - DNA, 10 bp, Artificial Sequence
  Description of Artificial Sequence: Synthetic oligonucleotide
  modified_base (10)..(10): a, c, t, g, unknown or other
gtgagtgcgn

SEQ ID NO: 3077 - DNA, 10 bp, Artificial Sequence
  Description of Artificial Sequence: Synthetic oligonucleotide
  modified_base (8)..(8): a, c, t, g, unknown or other
ttgagtangt

SEQ ID NO: 3078 - DNA, 10 bp, Artificial Sequence
  Description of Artificial Sequence: Synthetic oligonucleotide
  modified_base (8)..(8): a, c, t, g, unknown or other
  modified_base (10)..(10): a, c, t, g, unknown or other
ttgagtgngn

SEQ ID NO: 3079 - DNA, 10 bp, Artificial Sequence
  Description of Artificial Sequence: Synthetic oligonucleotide
  modified_base (10)..(10): a, c, t, g, unknown or other
ttgagtgagn

SEQ ID NO: 3080 - DNA, 10 bp, Artificial Sequence
  Description of Artificial Sequence: Synthetic oligonucleotide
  modified_base (10)..(10): a, c, t, g, unknown or other
ttgagtgcgn

SEQ ID NO: 3081 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
angagtgggn

SEQ ID NO: 3082 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
angagtgtgn

SEQ ID NO: 3083 - DNA, 10 bp, Artificial Sequence
  Description of Artificial Sequence: Synthetic oligonucleotide
  modified_base (2)..(2): a, c, t, g, unknown or other
angagtgaga

SEQ ID NO: 3084 - DNA, 10 bp, Artificial Sequence
  Description of Artificial Sequence: Synthetic oligonucleotide
  modified_base (2)..(2): a, c, t, g, unknown or other
angagtgcga

SEQ ID NO: 3085 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
nagagtgggn

SEQ ID NO: 3086 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
nagagtgtgn

SEQ ID NO: 3087 - DNA, 10 bp, Artificial Sequence
  Description of Artificial Sequence: Synthetic oligonucleotide
  modified_base (1)..(1): a, c, t, g, unknown or other
nagagtgaga

SEQ ID NO: 3088 - DNA, 10 bp, Artificial Sequence
  Description of Artificial Sequence: Synthetic oligonucleotide
  modified_base (1)..(1): a, c, t, g, unknown or other
nagagtgcga

SEQ ID NO: 3089 - DNA, 10 bp, Artificial Sequence
  Description of Artificial Sequence: Synthetic oligonucleotide
  modified_base (10)..(10): a, c, t, g, unknown or other
aagagtgggn

SEQ ID NO: 3090 - DNA, 10 bp, Artificial Sequence
  Description of Artificial Sequence: Synthetic oligonucleotide
  modified_base (10)..(10): a, c, t, g, unknown or other
aagagtgtgn

SEQ ID NO: 3091 - DNA, 10 bp, Artificial Sequence
  Description of Artificial Sequence: Synthetic oligonucleotide
aagagtgaga

SEQ ID NO: 3092 - DNA, 10 bp, Artificial Sequence
  Description of Artificial Sequence: Synthetic oligonucleotide
aagagtgcga

SEQ ID NO: 3093 - DNA, 10 bp, Artificial Sequence
  Description of Artificial Sequence: Synthetic oligonucleotide
  modified_base (10)..(10): a, c, t, g, unknown or other
cagagtgggn

SEQ ID NO: 3094 - DNA, 10 bp, Artificial Sequence
  Description of Artificial Sequence: Synthetic oligonucleotide
  modified_base (10)..(10): a, c, t, g, unknown or other
cagagtgtgn

SEQ ID NO: 3095 - DNA, 10 bp, Artificial Sequence
  Description of Artificial Sequence: Synthetic oligonucleotide
cagagtgaga

SEQ ID NO: 3096 - DNA, 10 bp, Artificial Sequence
  Description of Artificial Sequence: Synthetic oligonucleotide
cagagtgcga

SEQ ID NO: 3097 - DNA, 10 bp, Artificial Sequence
  Description of Artificial Sequence: Synthetic oligonucleotide
  modified_base (10)..(10): a, c, t, g, unknown or other
gagagtgggn

SEQ ID NO: 3098 - DNA, 10 bp, Artificial Sequence
  Description of Artificial Sequence: Synthetic oligonucleotide
  modified_base (10)..(10): a, c, t, g, unknown or other
gagagtgtgn

SEQ ID NO: 3099 - DNA, 10 bp, Artificial Sequence
  Description of Artificial Sequence: Synthetic oligonucleotide
gagagtgaga

SEQ ID NO: 3100 - DNA, 10 bp, Artificial Sequence
  Description of Artificial Sequence: Synthetic oligonucleotide
gagagtgcga

SEQ ID NO: 3101 - DNA, 10 bp, Artificial Sequence
  Description of Artificial Sequence: Synthetic oligonucleotide
  modified_base (10)..(10): a, c, t, g, unknown or other
tagagtgggn

SEQ ID NO: 3102 - DNA, 10 bp, Artificial Sequence
  Description of Artificial Sequence: Synthetic oligonucleotide
  modified_base (10)..(10): a, c, t, g, unknown or other
tagagtgtgn

SEQ ID NO: 3103 - DNA, 10 bp, Artificial Sequence
  Description of Artificial Sequence: Synthetic oligonucleotide
tagagtgaga

SEQ ID NO: 3104 - DNA, 10 bp, Artificial Sequence
  Description of Artificial Sequence: Synthetic oligonucleotide
tagagtgcga

SEQ ID NO: 3105 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
cngagtgggn

SEQ ID NO: 3106 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
cngagtgtgn

SEQ ID NO: 3107 - DNA, 10 bp, Artificial Sequence
  Description of Artificial Sequence: Synthetic oligonucleotide
  modified_base (2)..(2): a, c, t, g, unknown or other
cngagtgaga

SEQ ID NO: 3108 - DNA, 10 bp, Artificial Sequence
  Description of Artificial Sequence: Synthetic oligonucleotide
  modified_base (2)..(2): a, c, t, g, unknown or other
cngagtgcga

SEQ ID NO: 3109 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
ncgagtgggn

SEQ ID NO: 3110 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
ncgagtgtgn

SEQ ID NO: 3111 - DNA, 10 bp, Artificial Sequence
  Description of Artificial Sequence: Synthetic oligonucleotide
  modified_base (1)..(1): a, c, t, g, unknown or other
ncgagtgaga

SEQ ID NO: 3112 - DNA, 10 bp, Artificial Sequence
  Description of Artificial Sequence: Synthetic oligonucleotide
  modified_base (1)..(1): a, c, t, g, unknown or other
ncgagtgcga

SEQ ID NO: 3113 - DNA, 10 bp, Artificial Sequence
  Description of Artificial Sequence: Synthetic oligonucleotide
  modified_base (10)..(10): a, c, t, g, unknown or other
acgagtgggn

SEQ ID NO: 3114 - DNA, 10 bp, Artificial Sequence
  Description of Artificial Sequence: Synthetic oligonucleotide
  modified_base (10)..(10): a, c, t, g, unknown or other
acgagtgtgn

SEQ ID NO: 3115 - DNA, 10 bp, Artificial Sequence
  Description of Artificial Sequence: Synthetic oligonucleotide
acgagtgaga

SEQ ID NO: 3116 - DNA, 10 bp, Artificial Sequence
  Description of Artificial Sequence: Synthetic oligonucleotide
acgagtgcga

SEQ ID NO: 3117 - DNA, 10 bp, Artificial Sequence
  Description of Artificial Sequence: Synthetic oligonucleotide
  modified_base (10)..(10): a, c, t, g, unknown or other
ccgagtgggn

SEQ ID NO: 3118 - DNA, 10 bp, Artificial Sequence
  Description of Artificial Sequence: Synthetic oligonucleotide
  modified_base (10)..(10): a, c, t, g, unknown or other
ccgagtgtgn

SEQ ID NO: 3119 - DNA, 10 bp, Artificial Sequence
  Description of Artificial Sequence: Synthetic oligonucleotide
ccgagtgaga

SEQ ID NO: 3120 - DNA, 10 bp, Artificial Sequence
  Description of Artificial Sequence: Synthetic oligonucleotide
ccgagtgcga

SEQ ID NO: 3121 - DNA, 10 bp, Artificial Sequence
  Description of Artificial Sequence: Synthetic oligonucleotide
  modified_base (10)..(10): a, c, t, g, unknown or other
gcgagtgggn

SEQ ID NO: 3122 - DNA, 10 bp, Artificial Sequence
  Description of Artificial Sequence: Synthetic oligonucleotide
  modified_base (10)..(10): a, c, t, g, unknown or other
gcgagtgtgn

SEQ ID NO: 3123 - DNA, 10 bp, Artificial Sequence
  Description of Artificial Sequence: Synthetic oligonucleotide
gcgagtgaga

SEQ ID NO: 3124 - DNA, 10 bp, Artificial Sequence
  Description of Artificial Sequence: Synthetic oligonucleotide
gcgagtgcga

SEQ ID NO: 3125 - DNA, 10 bp, Artificial Sequence
  Description of Artificial Sequence: Synthetic oligonucleotide
  modified_base (10)..(10): a, c, t, g, unknown or other
tcgagtgggn

SEQ ID NO: 3126 - DNA, 10 bp, Artificial Sequence
  Description of Artificial Sequence: Synthetic oligonucleotide
  modified_base (10)..(10): a, c, t, g, unknown or other
tcgagtgtgn

SEQ ID NO: 3127 - DNA, 10 bp, Artificial Sequence
  Description of Artificial Sequence: Synthetic oligonucleotide
tcgagtgaga

SEQ ID NO: 3128 - DNA, 10 bp, Artificial Sequence
  Description of Artificial Sequence: Synthetic oligonucleotide
tcgagtgcga

SEQ ID NO: 3129 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
gngagtgggn

SEQ ID NO: 3130 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
gngagtgtgn

SEQ ID NO: 3131 - DNA, 10 bp, Artificial Sequence
  Description of Artificial Sequence: Synthetic oligonucleotide
  modified_base (2)..(2): a, c, t, g, unknown or other
gngagtgaga

SEQ ID NO: 3132 - DNA, 10 bp, Artificial Sequence
  Description of Artificial Sequence: Synthetic oligonucleotide
  modified_base (2)..(2): a, c, t, g, unknown or other
gngagtgcga

SEQ ID NO: 3133 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
nggagtgggn

SEQ ID NO: 3134 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
nggagtgtgn

SEQ ID NO: 3135 - DNA, 10 bp, Artificial Sequence
  Description of Artificial Sequence: Synthetic oligonucleotide
  modified_base (1)..(1): a, c, t, g, unknown or other
nggagtgaga

SEQ ID NO: 3136 - DNA, 10 bp, Artificial Sequence
  Description of Artificial Sequence: Synthetic oligonucleotide
  modified_base (1)..(1): a, c, t, g, unknown or other
nggagtgcga

SEQ ID NO: 3137 - DNA, 10 bp, Artificial Sequence
  Description of Artificial Sequence: Synthetic oligonucleotide
  modified_base (10)..(10): a, c, t, g, unknown or other
aggagtgggn

SEQ ID NO: 3138 - DNA, 10 bp, Artificial Sequence
  Description of Artificial Sequence: Synthetic oligonucleotide
  modified_base (10)..(10): a, c, t, g, unknown or other
aggagtgtgn

SEQ ID NO: 3139 - DNA, 10 bp, Artificial Sequence
  Description of Artificial Sequence: Synthetic oligonucleotide
aggagtgaga

SEQ ID NO: 3140 - DNA, 10 bp, Artificial Sequence
  Description of Artificial Sequence: Synthetic oligonucleotide
aggagtgcga

SEQ ID NO: 3141 - DNA, 10 bp, Artificial Sequence
  Description of Artificial Sequence: Synthetic oligonucleotide
  modified_base (10)..(10): a, c, t, g, unknown or other
cggagtgggn

SEQ ID NO: 3142 - DNA, 10 bp, Artificial Sequence
  Description of Artificial Sequence: Synthetic oligonucleotide
  modified_base (10)..(10): a, c, t, g, unknown or other
cggagtgtgn

SEQ ID NO: 3143 - DNA, 10 bp, Artificial Sequence
  Description of Artificial Sequence: Synthetic oligonucleotide
cggagtgaga

SEQ ID NO: 3144 - DNA, 10 bp, Artificial Sequence
  Description of Artificial Sequence: Synthetic oligonucleotide
cggagtgcga

SEQ ID NO: 3145 - DNA, 10 bp, Artificial Sequence
  Description of Artificial Sequence: Synthetic oligonucleotide
  modified_base (10)..(10): a, c, t, g, unknown or other
gggagtgggn

SEQ ID NO: 3146 - DNA, 10 bp, Artificial Sequence
  Description of Artificial Sequence: Synthetic oligonucleotide
  modified_base (10)..(10): a, c, t, g, unknown or other
gggagtgtgn

SEQ ID NO: 3147 - DNA, 10 bp, Artificial Sequence
  Description of Artificial Sequence: Synthetic oligonucleotide
gggagtgaga

SEQ ID NO: 3148 - DNA, 10 bp, Artificial Sequence
  Description of Artificial Sequence: Synthetic oligonucleotide
gggagtgcga

SEQ ID NO: 3149 - DNA, 10 bp, Artificial Sequence
  Description of Artificial Sequence: Synthetic oligonucleotide
  modified_base (10)..(10): a, c, t, g, unknown or other
tggagtgggn

SEQ ID NO: 3150 - DNA, 10 bp, Artificial Sequence
  Description of Artificial Sequence: Synthetic oligonucleotide
  modified_base (10)..(10): a, c, t, g, unknown or other
tggagtgtgn

SEQ ID NO: 3151 - DNA, 10 bp, Artificial Sequence
  Description of Artificial Sequence: Synthetic oligonucleotide
tggagtgaga

SEQ ID NO: 3152 - DNA, 10 bp, Artificial Sequence
  Description of Artificial Sequence: Synthetic oligonucleotide
tggagtgcga

SEQ ID NO: 3153 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
tngagtgggn

SEQ ID NO: 3154 - DNA, 10 bp, Artificial Sequence
  Description of Artificial Sequence: Synthetic oligonucleotide
  modified_base (2)..(2): a, c, t, g, unknown or other
  modified_base (10)..(10): a, c, t, g, unknown or other
tngagtgtgn

SEQ ID NO: 3155 - DNA, 10 bp, Artificial Sequence
  Description of Artificial Sequence: Synthetic oligonucleotide
  modified_base (2)..(2): a, c, t, g, unknown or other
tngagtgaga

SEQ ID NO: 3156 - DNA, 10 bp, Artificial Sequence
  Description of Artificial Sequence: Synthetic oligonucleotide
  modified_base (2)..(2): a, c, t, g, unknown or other
tngagtgcga

SEQ ID NO: 3157 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
ntgagtgggn

SEQ ID NO: 3158 - DNA, 10 bp, Artificial Sequence
  Description of Artificial Sequence: Synthetic oligonucleotide
  modified_base (1)..(1): a, c, t, g, unknown or other
  modified_base (10)..(10): a, c, t, g, unknown or other
ntgagtgtgn

SEQ ID NO: 3159 - DNA, 10 bp, Artificial Sequence
  Description of Artificial Sequence: Synthetic oligonucleotide
  modified_base (1)..(1): a, c, t, g, unknown or other
ntgagtgaga

SEQ ID NO: 3160 - DNA, 10 bp, Artificial Sequence
  Description of Artificial Sequence: Synthetic oligonucleotide
  modified_base (1)..(1): a, c, t, g, unknown or other
ntgagtgcga

SEQ ID NO: 3161 - DNA, 10 bp, Artificial Sequence
  Description of Artificial Sequence: Synthetic oligonucleotide
  modified_base (10)..(10): a, c, t, g, unknown or other
atgagtgggn

SEQ ID NO: 3162 - DNA, 10 bp, Artificial Sequence
  Description of Artificial Sequence: Synthetic oligonucleotide
  modified_base (10)..(10): a, c, t, g, unknown or other
atgagtgtgn

SEQ ID NO: 3163 - DNA, 10 bp, Artificial Sequence
  Description of Artificial Sequence: Synthetic oligonucleotide
atgagtgaga

SEQ ID NO: 3164 - DNA, 10 bp, Artificial Sequence
  Description of Artificial Sequence: Synthetic oligonucleotide
atgagtgcga

SEQ ID NO: 3165 - DNA, 10 bp, Artificial Sequence
  Description of Artificial Sequence: Synthetic oligonucleotide
  modified_base (10)..(10): a, c, t, g, unknown or other
ctgagtgggn

SEQ ID NO: 3166 - DNA, 10 bp, Artificial Sequence
  Description of Artificial Sequence: Synthetic oligonucleotide
  modified_base (10)..(10): a, c, t, g, unknown or other
ctgagtgtgn

SEQ ID NO: 3167 - DNA, 10 bp, Artificial Sequence
  Description of Artificial Sequence: Synthetic oligonucleotide
ctgagtgaga

SEQ ID NO: 3168 - DNA, 10 bp, Artificial Sequence
  Description of Artificial Sequence: Synthetic oligonucleotide
ctgagtgcga

SEQ ID NO: 3169 - DNA, 10 bp, Artificial Sequence
  Description of Artificial Sequence: Synthetic oligonucleotide
  modified_base (10)..(10): a, c, t, g, unknown or other
gtgagtgggn

SEQ ID NO: 3170 - DNA, 10 bp, Artificial Sequence
  Description of Artificial Sequence: Synthetic oligonucleotide
  modified_base (10)..(10): a, c, t, g, unknown or other
gtgagtgtgn

SEQ ID NO: 3171 - DNA, 10 bp, Artificial Sequence
  Description of Artificial Sequence: Synthetic oligonucleotide
gtgagtgaga

SEQ ID NO: 3172 - DNA, 10 bp, Artificial Sequence
  Description of Artificial Sequence: Synthetic oligonucleotide
gtgagtgcga

SEQ ID NO: 3173 - DNA, 10 bp, Artificial Sequence
  Description of Artificial Sequence: Synthetic oligonucleotide
  modified_base (10)..(10): a, c, t, g, unknown or other
ttgagtgggn

SEQ ID NO: 3174 - DNA, 10 bp, Artificial Sequence
  Description of Artificial Sequence: Synthetic oligonucleotide
  modified_base (10)..(10): a, c, t, g, unknown or other
ttgagtgtgn

SEQ ID NO: 3175 - DNA, 10 bp, Artificial Sequence
  Description of Artificial Sequence: Synthetic oligonucleotide
ttgagtgaga

SEQ ID NO: 3176 - DNA, 10 bp, Artificial Sequence
  Description of Artificial Sequence: Synthetic oligonucleotide
ttgagtgcga

SEQ ID NO: 3177 - DNA, 10 bp, Artificial Sequence
  Description of Artificial Sequence: Synthetic oligonucleotide
  modified_base (2)..(2): a, c, t, g, unknown or other
angagtggga

SEQ ID NO: 3178 - DNA, 10 bp, Artificial Sequence
  Description of Artificial Sequence: Synthetic oligonucleotide
  modified_base (2)..(2): a, c, t, g, unknown or other
angagtgtga

SEQ ID NO: 3179 - DNA, 10 bp, Artificial Sequence
  Description of Artificial Sequence: Synthetic oligonucleotide
  modified_base (2)..(2): a, c, t, g, unknown or other
angagtgagc

SEQ ID NO: 3180 - DNA, 10 bp, Artificial Sequence
  Description of Artificial Sequence: Synthetic oligonucleotide
  modified_base (2)..(2): a, c, t, g, unknown or other
angagtgcgc

SEQ ID NO: 3181 - DNA, 10 bp, Artificial Sequence
  Description of Artificial Sequence: Synthetic oligonucleotide
  modified_base (1)..(1): a, c, t, g, unknown or other
nagagtggga

SEQ ID NO: 3182 - DNA, 10 bp, Artificial Sequence
  Description of Artificial Sequence: Synthetic oligonucleotide
  modified_base (1)..(1): a, c, t, g, unknown or other
nagagtgtga

SEQ ID NO: 3183 - DNA, 10 bp, Artificial Sequence
  Description of Artificial Sequence: Synthetic oligonucleotide
  modified_base (1)..(1): a, c, t, g, unknown or other
nagagtgagc

SEQ ID NO: 3184 - DNA, 10 bp, Artificial Sequence
  Description of Artificial Sequence: Synthetic oligonucleotide
  modified_base (1)..(1): a, c, t, g, unknown or other
nagagtgcgc

SEQ ID NO: 3185 - DNA, 10 bp, Artificial Sequence
  Description of Artificial Sequence: Synthetic oligonucleotide
aagagtggga

SEQ ID NO: 3186 - DNA, 10 bp, Artificial Sequence
  Description of Artificial Sequence: Synthetic oligonucleotide
aagagtgtga

SEQ ID NO: 3187 - DNA, 10 bp, Artificial Sequence
  Description of Artificial Sequence: Synthetic oligonucleotide
aagagtgagc

SEQ ID NO: 3188 - DNA, 10 bp, Artificial Sequence
  Description of Artificial Sequence: Synthetic oligonucleotide
aagagtgcgc

SEQ ID NO: 3189 - DNA, 10 bp, Artificial Sequence
  Description of Artificial Sequence: Synthetic oligonucleotide
cagagtggga

SEQ ID NO: 3190 - DNA, 10 bp, Artificial Sequence
  Description of Artificial Sequence: Synthetic oligonucleotide
cagagtgtga

SEQ ID NO: 3191 - DNA, 10 bp, Artificial Sequence
  Description of Artificial Sequence: Synthetic oligonucleotide
cagagtgagc

SEQ ID NO: 3192 - DNA, 10 bp, Artificial Sequence
  Description of Artificial Sequence: Synthetic oligonucleotide
cagagtgcgc

SEQ ID NO: 3193 - DNA, 10 bp, Artificial Sequence
  Description of Artificial Sequence: Synthetic oligonucleotide
gagagtggga

SEQ ID NO: 3194 - DNA, 10 bp, Artificial Sequence
  Description of Artificial Sequence: Synthetic oligonucleotide
gagagtgtga

SEQ ID NO: 3195 - DNA, 10 bp, Artificial Sequence
  Description of Artificial Sequence: Synthetic oligonucleotide
gagagtgagc

SEQ ID NO: 3196 - DNA, 10 bp, Artificial Sequence
  Description of Artificial Sequence: Synthetic oligonucleotide
gagagtgcgc

SEQ ID NO: 3197 - DNA, 10 bp, Artificial Sequence
  Description of Artificial Sequence: Synthetic oligonucleotide
tagagtggga

SEQ ID NO: 3198 - DNA, 10 bp, Artificial Sequence
  Description of Artificial Sequence: Synthetic oligonucleotide
tagagtgtga

SEQ ID NO: 3199 - DNA, 10 bp, Artificial Sequence
  Description of Artificial Sequence: Synthetic oligonucleotide
tagagtgagc

SEQ ID NO: 3200 - DNA, 10 bp, Artificial Sequence
  Description of Artificial Sequence: Synthetic oligonucleotide
tagagtgcgc

SEQ ID NO: 3201 - DNA, 10 bp, Artificial Sequence
  Description of Artificial Sequence: Synthetic oligonucleotide
  modified_base (2)..(2): a, c, t, g, unknown or other
cngagtggga

SEQ ID NO: 3202 - DNA, 10 bp, Artificial Sequence
  Description of Artificial Sequence: Synthetic oligonucleotide
  modified_base (2)..(2): a, c, t, g, unknown or other
cngagtgtga

SEQ ID NO: 3203 - DNA, 10 bp, Artificial Sequence
  Description of Artificial Sequence: Synthetic oligonucleotide
  modified_base (2)..(2): a, c, t, g, unknown or other
cngagtgagc

SEQ ID NO: 3204 - DNA, 10 bp, Artificial Sequence
  Description of Artificial Sequence: Synthetic oligonucleotide
  modified_base (2)..(2): a, c, t, g, unknown or other
cngagtgcgc

SEQ ID NO: 3205 - DNA, 10 bp, Artificial Sequence
  Description of Artificial Sequence: Synthetic oligonucleotide
  modified_base (1)..(1): a, c, t, g, unknown or other
ncgagtggga

SEQ ID NO: 3206 - DNA, 10 bp, Artificial Sequence
  Description of Artificial Sequence: Synthetic oligonucleotide
  modified_base (1)..(1): a, c, t, g, unknown or other
ncgagtgtga

SEQ ID NO: 3207 - DNA, 10 bp, Artificial Sequence
  Description of Artificial Sequence: Synthetic oligonucleotide
  modified_base (1)..(1): a, c, t, g, unknown or other
ncgagtgagc

SEQ ID NO: 3208 - DNA, 10 bp, Artificial Sequence
  Description of Artificial Sequence: Synthetic oligonucleotide
  modified_base (1)..(1): a, c, t, g, unknown or other
ncgagtgcgc

SEQ ID NO: 3209 - DNA, 10 bp, Artificial Sequence
  Description of Artificial Sequence: Synthetic oligonucleotide
acgagtggga

SEQ ID NO: 3210 - DNA, 10 bp, Artificial Sequence
  Description of Artificial Sequence: Synthetic oligonucleotide
acgagtgtga

SEQ ID NO: 3211 - DNA, 10 bp, Artificial Sequence
  Description of Artificial Sequence: Synthetic oligonucleotide
acgagtgagc

SEQ ID NO: 3212 - DNA, 10 bp, Artificial Sequence
  Description of Artificial Sequence: Synthetic oligonucleotide
acgagtgcgc

SEQ ID NO: 3213 - DNA, 10 bp, Artificial Sequence
  Description of Artificial Sequence: Synthetic oligonucleotide
ccgagtggga

SEQ ID NO: 3214 - DNA, 10 bp, Artificial Sequence
  Description of Artificial Sequence: Synthetic oligonucleotide
ccgagtgtga

SEQ ID NO: 3215 - DNA, 10 bp, Artificial Sequence
  Description of Artificial Sequence: Synthetic oligonucleotide
ccgagtgagc

SEQ ID NO: 3216 - DNA, 10 bp, Artificial Sequence
  Description of Artificial Sequence: Synthetic oligonucleotide
ccgagtgcgc

SEQ ID NO: 3217 - DNA, 10 bp, Artificial Sequence
  Description of Artificial Sequence: Synthetic oligonucleotide
gcgagtggga

SEQ ID NO: 3218 - DNA, 10 bp, Artificial Sequence
  Description of Artificial Sequence: Synthetic oligonucleotide
gcgagtgtga

SEQ ID NO: 3219 - DNA, 10 bp, Artificial Sequence
  Description of Artificial Sequence: Synthetic oligonucleotide
gcgagtgagc

SEQ ID NO: 3220 - DNA, 10 bp, Artificial Sequence
  Description of Artificial Sequence: Synthetic oligonucleotide
gcgagtgcgc

SEQ ID NO: 3221 - DNA, 10 bp, Artificial Sequence
  Description of Artificial Sequence: Synthetic oligonucleotide
tcgagtggga

SEQ ID NO: 3222 - DNA, 10 bp, Artificial Sequence
  Description of Artificial Sequence: Synthetic oligonucleotide
tcgagtgtga

SEQ ID NO: 3223 - DNA, 10 bp, Artificial Sequence
  Description of Artificial Sequence: Synthetic oligonucleotide
tcgagtgagc

SEQ ID NO: 3224 - DNA, 10 bp, Artificial Sequence
  Description of Artificial Sequence: Synthetic oligonucleotide
tcgagtgcgc

SEQ ID NO: 3225 - DNA, 10 bp, Artificial Sequence
  Description of Artificial Sequence: Synthetic oligonucleotide
  modified_base (2)..(2): a, c, t, g, unknown or other
gngagtggga

SEQ ID NO: 3226 - DNA, 10 bp, Artificial Sequence
  Description of Artificial Sequence: Synthetic oligonucleotide
  modified_base (2)..(2): a, c, t, g, unknown or other
gngagtgtga

SEQ ID NO: 3227 - DNA, 10 bp, Artificial Sequence
  Description of Artificial Sequence: Synthetic oligonucleotide
  modified_base (2)..(2): a, c, t, g, unknown or other
gngagtgagc

SEQ ID NO: 3228 - DNA, 10 bp, Artificial Sequence
  Description of Artificial Sequence: Synthetic oligonucleotide
  modified_base (2)..(2): a, c, t, g, unknown or other
gngagtgcgc

SEQ ID NO: 3229 - DNA, 10 bp, Artificial Sequence
  Description of Artificial Sequence: Synthetic oligonucleotide
  modified_base (1)..(1): a, c, t, g, unknown or other
nggagtggga

SEQ ID NO: 3230 - DNA, 10 bp, Artificial Sequence
  Description of Artificial Sequence: Synthetic oligonucleotide
  modified_base (1)..(1): a, c, t, g, unknown or other
nggagtgtga

SEQ ID NO: 3231 - DNA, 10 bp, Artificial Sequence
  Description of Artificial Sequence: Synthetic oligonucleotide
  modified_base (1)..(1): a, c, t, g, unknown or other
nggagtgagc

SEQ ID NO: 3232 - DNA, 10 bp, Artificial Sequence
  Description of Artificial Sequence: Synthetic oligonucleotide
  modified_base (1)..(1): a, c, t, g, unknown or other
nggagtgcgc

SEQ ID NO: 3233 - DNA, 10 bp, Artificial Sequence
  Description of Artificial Sequence: Synthetic oligonucleotide
aggagtggga

SEQ ID NO: 3234 - DNA, 10 bp, Artificial Sequence
  Description of Artificial Sequence: Synthetic oligonucleotide
aggagtgtga

SEQ ID NO: 3235 - DNA, 10 bp, Artificial Sequence
  Description of Artificial Sequence: Synthetic oligonucleotide
aggagtgagc

SEQ ID NO: 3236 - DNA, 10 bp, Artificial Sequence
  Description of Artificial Sequence: Synthetic oligonucleotide
aggagtgcgc

SEQ ID NO: 3237 - DNA, 10 bp, Artificial Sequence
  Description of Artificial Sequence: Synthetic oligonucleotide
cggagtggga

SEQ ID NO: 3238 - DNA, 10 bp, Artificial Sequence
  Description of Artificial Sequence: Synthetic oligonucleotide
cggagtgtga

SEQ ID NO: 3239 - DNA, 10 bp, Artificial Sequence
  Description of Artificial Sequence: Synthetic oligonucleotide
cggagtgagc

SEQ ID NO: 3240 - DNA, 10 bp, Artificial Sequence
  Description of Artificial Sequence: Synthetic oligonucleotide
cggagtgcgc

SEQ ID NO: 3241 - DNA, 10 bp, Artificial Sequence
  Description of Artificial Sequence: Synthetic oligonucleotide
gggagtggga

SEQ ID NO: 3242 - DNA, 10 bp, Artificial Sequence
  Description of Artificial Sequence: Synthetic oligonucleotide
gggagtgtga

SEQ ID NO: 3243 - DNA, 10 bp, Artificial Sequence
  Description of Artificial Sequence: Synthetic oligonucleotide
gggagtgagc

SEQ ID NO: 3244 - DNA, 10 bp, Artificial Sequence
  Description of Artificial Sequence: Synthetic oligonucleotide
gggagtgcgc

SEQ ID NO: 3245 - DNA, 10 bp, Artificial Sequence
  Description of Artificial Sequence: Synthetic oligonucleotide
tggagtggga

SEQ ID NO: 3246 - DNA, 10 bp, Artificial Sequence
  Description of Artificial Sequence: Synthetic oligonucleotide
tggagtgtga

SEQ ID NO: 3247 - DNA, 10 bp, Artificial Sequence
  Description of Artificial Sequence: Synthetic oligonucleotide
tggagtgagc

SEQ ID NO: 3248 - DNA, 10 bp, Artificial Sequence
  Description of Artificial Sequence: Synthetic oligonucleotide
tggagtgcgc

SEQ ID NO: 3249 - DNA, 10 bp, Artificial Sequence
  Description of Artificial Sequence: Synthetic oligonucleotide
  modified_base (2)..(2): a, c, t, g, unknown or other
tngagtggga

SEQ ID NO: 3250 - DNA, 10 bp, Artificial Sequence
  Description of Artificial Sequence: Synthetic oligonucleotide
  modified_base (2)..(2): a, c, t, g, unknown or other
tngagtgtga

SEQ ID NO: 3251 - DNA, 10 bp, Artificial Sequence
  Description of Artificial Sequence: Synthetic oligonucleotide
  modified_base (2)..(2): a, c, t, g, unknown or other
tngagtgagc

SEQ ID NO: 3252 - DNA, 10 bp, Artificial Sequence
  Description of Artificial Sequence: Synthetic oligonucleotide
  modified_base (2)..(2): a, c, t, g, unknown or other
tngagtgcgc

SEQ ID NO: 3253 - DNA, 10 bp, Artificial Sequence
  Description of Artificial Sequence: Synthetic oligonucleotide
  modified_base (1)..(1): a, c, t, g, unknown or other
ntgagtggga

SEQ ID NO: 3254 - DNA, 10 bp, Artificial Sequence
  Description of Artificial Sequence: Synthetic oligonucleotide
  modified_base (1)..(1): a, c, t, g, unknown or other
ntgagtgtga

SEQ ID NO: 3255 - DNA, 10 bp, Artificial Sequence
  Description of Artificial Sequence: Synthetic oligonucleotide
  modified_base (1)..(1): a, c, t, g, unknown or other
ntgagtgagc

SEQ ID NO: 3256 - DNA, 10 bp, Artificial Sequence
  Description of Artificial Sequence: Synthetic oligonucleotide
  modified_base (1)..(1): a, c, t, g, unknown or other
ntgagtgcgc

SEQ ID NO: 3257 - DNA, 10 bp, Artificial Sequence
  Description of Artificial Sequence: Synthetic oligonucleotide
atgagtggga

SEQ ID NO: 3258 - DNA, 10 bp, Artificial Sequence
  Description of Artificial Sequence: Synthetic oligonucleotide
atgagtgtga

SEQ ID NO: 3259 - DNA, 10 bp, Artificial Sequence
  Description of Artificial Sequence: Synthetic oligonucleotide
atgagtgagc

SEQ ID NO: 3260 - DNA, 10 bp, Artificial Sequence
  Description of Artificial Sequence: Synthetic oligonucleotide
atgagtgcgc

SEQ ID NO: 3261 - DNA, 10 bp, Artificial Sequence
  Description of Artificial Sequence: Synthetic oligonucleotide
ctgagtggga

SEQ ID NO: 3262 - DNA, 10 bp, Artificial Sequence
  Description of Artificial Sequence: Synthetic oligonucleotide
ctgagtgtga

SEQ ID NO: 3263 - DNA, 10 bp, Artificial Sequence
  Description of Artificial Sequence: Synthetic oligonucleotide
ctgagtgagc

SEQ ID NO: 3264 - DNA, 10 bp, Artificial Sequence
  Description of Artificial Sequence: Synthetic oligonucleotide
ctgagtgcgc

SEQ ID NO: 3265 - DNA, 10 bp, Artificial Sequence
  Description of Artificial Sequence: Synthetic oligonucleotide
gtgagtggga

SEQ ID NO: 3266 - DNA, 10 bp, Artificial Sequence
  Description of Artificial Sequence: Synthetic oligonucleotide
gtgagtgtga

SEQ ID NO: 3267 - DNA, 10 bp, Artificial Sequence
  Description of Artificial Sequence: Synthetic oligonucleotide
gtgagtgagc

SEQ ID NO: 3268 - DNA, 10 bp, Artificial Sequence
  Description of Artificial Sequence: Synthetic oligonucleotide
gtgagtgcgc

SEQ ID NO: 3269 - DNA, 10 bp, Artificial Sequence
  Description of Artificial Sequence: Synthetic oligonucleotide
ttgagtggga

SEQ ID NO: 3270 - DNA, 10 bp, Artificial Sequence
  Description of Artificial Sequence: Synthetic oligonucleotide
ttgagtgtga

SEQ ID NO: 3271 - DNA, 10 bp, Artificial Sequence
  Description of Artificial Sequence: Synthetic oligonucleotide
ttgagtgagc

SEQ ID NO: 3272 - DNA, 10 bp, Artificial Sequence
  Description of Artificial Sequence: Synthetic oligonucleotide
ttgagtgcgc

SEQ ID NO: 3273 - DNA, 10 bp, Artificial Sequence
  Description of Artificial Sequence: Synthetic oligonucleotide
  modified_base (2)..(2): a, c, t, g, unknown or other
angagtgggc

SEQ ID NO: 3274 - DNA, 10 bp, Artificial Sequence
  Description of Artificial Sequence: Synthetic oligonucleotide
  modified_base (2)..(2): a, c, t, g, unknown or other
angagtgtgc

SEQ ID NO: 3275 - DNA, 10 bp, Artificial Sequence
  Description of Artificial Sequence: Synthetic oligonucleotide
  modified_base (2)..(2): a, c, t, g, unknown or other
angagtgagg

SEQ ID NO: 3276 - DNA, 10 bp, Artificial Sequence
  Description of Artificial Sequence: Synthetic oligonucleotide
  modified_base (2)..(2): a, c, t, g, unknown or other
angagtgcgg

SEQ ID NO: 3277 - DNA, 10 bp, Artificial Sequence
  Description of Artificial Sequence: Synthetic oligonucleotide
  modified_base (1)..(1): a, c, t, g, unknown or other
nagagtgggc

SEQ ID NO: 3278 - DNA, 10 bp, Artificial Sequence
  Description of Artificial Sequence: Synthetic oligonucleotide
  modified_base (1)..(1): a, c, t, g, unknown or other
nagagtgtgc

SEQ ID NO: 3279 - DNA, 10 bp, Artificial Sequence
  Description of Artificial Sequence: Synthetic oligonucleotide
  modified_base (1)..(1): a, c, t, g, unknown or other
nagagtgagg

SEQ ID NO: 3280 - DNA, 10 bp, Artificial Sequence
  Description of Artificial Sequence: Synthetic oligonucleotide
  modified_base (1)..(1): a, c, t, g, unknown or other
nagagtgcgg

SEQ ID NO: 3281 - DNA, 10 bp, Artificial Sequence
  Description of Artificial Sequence: Synthetic oligonucleotide
aagagtgggc

SEQ ID NO: 3282 - DNA, 10 bp, Artificial Sequence
  Description of Artificial Sequence: Synthetic oligonucleotide
aagagtgtgc

SEQ ID NO: 3283 - DNA, 10 bp, Artificial Sequence
  Description of Artificial Sequence: Synthetic oligonucleotide
aagagtgagg

SEQ ID NO: 3284 - DNA, 10 bp, Artificial Sequence
  Description of Artificial Sequence: Synthetic oligonucleotide
aagagtgcgg

SEQ ID NO: 3285 - DNA, 10 bp, Artificial Sequence
  Description of Artificial Sequence: Synthetic oligonucleotide
cagagtgggc

SEQ ID NO: 3286 - DNA, 10 bp, Artificial Sequence
  Description of Artificial Sequence: Synthetic oligonucleotide
cagagtgtgc

SEQ ID NO: 3287 - DNA, 10 bp, Artificial Sequence
  Description of Artificial Sequence: Synthetic oligonucleotide
cagagtgagg

SEQ ID NO: 3288 - DNA, 10 bp, Artificial Sequence
  Description of Artificial Sequence: Synthetic oligonucleotide
cagagtgcgg

SEQ ID NO: 3289 - DNA, 10 bp, Artificial Sequence
  Description of Artificial Sequence: Synthetic oligonucleotide
gagagtgggc

SEQ ID NO: 3290 - DNA, 10 bp, Artificial Sequence
  Description of Artificial Sequence: Synthetic oligonucleotide
gagagtgtgc

SEQ ID NO: 3291 - DNA, 10 bp, Artificial Sequence
  Description of Artificial Sequence: Synthetic oligonucleotide
gagagtgagg

SEQ ID NO: 3292 - DNA, 10 bp, Artificial Sequence
  Description of Artificial Sequence: Synthetic oligonucleotide
gagagtgcgg

SEQ ID NO: 3293 - DNA, 10 bp, Artificial Sequence
  Description of Artificial Sequence: Synthetic oligonucleotide
tagagtgggc

SEQ ID NO: 3294 - DNA, 10 bp, Artificial Sequence
  Description of Artificial Sequence: Synthetic oligonucleotide
tagagtgtgc

SEQ ID NO: 3295 - DNA, 10 bp, Artificial Sequence
  Description of Artificial Sequence: Synthetic oligonucleotide
tagagtgagg

SEQ ID NO: 3296 - DNA, 10 bp, Artificial Sequence
  Description of Artificial Sequence: Synthetic oligonucleotide
tagagtgcgg

SEQ ID NO: 3297 - DNA, 10 bp, Artificial Sequence
  Description of Artificial Sequence: Synthetic oligonucleotide
  modified_base (2)..(2): a, c, t, g, unknown or other
cngagtgggc

SEQ ID NO: 3298 - DNA, 10 bp, Artificial Sequence
  Description of Artificial Sequence: Synthetic oligonucleotide
  modified_base (2)..(2): a, c, t, g, unknown or other
cngagtgtgc

SEQ ID NO: 3299 - DNA, 10 bp, Artificial Sequence
  Description of Artificial Sequence: Synthetic oligonucleotide
  modified_base (2)..(2): a, c, t, g, unknown or other
cngagtgagg

SEQ ID NO: 3300 - DNA, 10 bp, Artificial Sequence
  Description of Artificial Sequence: Synthetic oligonucleotide
  modified_base (2)..(2): a, c, t, g, unknown or other
cngagtgcgg

SEQ ID NO: 3301 - DNA, 10 bp, Artificial Sequence
  Description of Artificial Sequence: Synthetic oligonucleotide
  modified_base (1)..(1): a, c, t, g, unknown or other
ncgagtgggc

SEQ ID NO: 3302 - DNA, 10 bp, Artificial Sequence
  Description of Artificial Sequence: Synthetic oligonucleotide
  modified_base (1)..(1): a, c, t, g, unknown or other
ncgagtgtgc

SEQ ID NO: 3303 - DNA, 10 bp, Artificial Sequence
  Description of Artificial Sequence: Synthetic oligonucleotide
  modified_base (1)..(1): a, c, t, g, unknown or other
ncgagtgagg

SEQ ID NO: 3304 - DNA, 10 bp, Artificial Sequence
  Description of Artificial Sequence: Synthetic oligonucleotide
  modified_base (1)..(1): a, c, t, g, unknown or other
ncgagtgcgg

SEQ ID NO: 3305 - DNA, 10 bp, Artificial Sequence
  Description of Artificial Sequence: Synthetic oligonucleotide
acgagtgggc

SEQ ID NO: 3306 - DNA, 10 bp, Artificial Sequence
  Description of Artificial Sequence: Synthetic oligonucleotide
acgagtgtgc

SEQ ID NO: 3307 - DNA, 10 bp, Artificial Sequence
  Description of Artificial Sequence: Synthetic oligonucleotide
acgagtgagg

SEQ ID NO: 3308 - DNA, 10 bp, Artificial Sequence
  Description of Artificial Sequence: Synthetic oligonucleotide
acgagtgcgg

SEQ ID NO: 3309 - DNA, 10 bp, Artificial Sequence
  Description of Artificial Sequence: Synthetic oligonucleotide
ccgagtgggc

SEQ ID NO: 3310 - DNA, 10 bp, Artificial Sequence
  Description of Artificial Sequence: Synthetic oligonucleotide
ccgagtgtgc

SEQ ID NO: 3311 - DNA, 10 bp, Artificial Sequence
  Description of Artificial Sequence: Synthetic oligonucleotide
ccgagtgagg

SEQ ID NO: 3312 - DNA, 10 bp, Artificial Sequence
  Description of Artificial Sequence: Synthetic oligonucleotide
ccgagtgcgg

SEQ ID NO: 3313 - DNA, 10 bp, Artificial Sequence
  Description of Artificial Sequence: Synthetic oligonucleotide
gcgagtgggc

SEQ ID NO: 3314 - DNA, 10 bp, Artificial Sequence
  Description of Artificial Sequence: Synthetic oligonucleotide
gcgagtgtgc

SEQ ID NO: 3315 - DNA, 10 bp, Artificial Sequence
  Description of Artificial Sequence: Synthetic oligonucleotide
gcgagtgagg

SEQ ID NO: 3316 - DNA, 10 bp, Artificial Sequence
  Description of Artificial Sequence: Synthetic oligonucleotide
gcgagtgcgg

SEQ ID NO: 3317 - DNA, 10 bp, Artificial Sequence
  Description of Artificial Sequence: Synthetic oligonucleotide
tcgagtgggc

SEQ ID NO: 3318 - DNA, 10 bp, Artificial Sequence
  Description of Artificial Sequence: Synthetic oligonucleotide
tcgagtgtgc

SEQ ID NO: 3319 - DNA, 10 bp, Artificial Sequence
  Description of Artificial Sequence: Synthetic oligonucleotide
tcgagtgagg

SEQ ID NO: 3320 - DNA, 10 bp, Artificial Sequence
  Description of Artificial Sequence: Synthetic oligonucleotide
tcgagtgcgg

SEQ ID NO: 3321 - DNA, 10 bp, Artificial Sequence
  Description of Artificial Sequence: Synthetic oligonucleotide
  modified_base (2)..(2): a, c, t, g, unknown or other
gngagtgggc

SEQ ID NO: 3322 - DNA, 10 bp, Artificial Sequence
  Description of Artificial Sequence: Synthetic oligonucleotide
  modified_base (2)..(2): a, c, t, g, unknown or other
gngagtgtgc

SEQ ID NO: 3323 - DNA, 10 bp, Artificial Sequence
  Description of Artificial Sequence: Synthetic oligonucleotide
  modified_base (2)..(2): a, c, t, g, unknown or other
gngagtgagg

SEQ ID NO: 3324 - DNA, 10 bp, Artificial Sequence
  Description of Artificial Sequence: Synthetic oligonucleotide
  modified_base (2)..(2): a, c, t, g, unknown or other
gngagtgcgg

SEQ ID NO: 3325 - DNA, 10 bp, Artificial Sequence
  Description of Artificial Sequence: Synthetic oligonucleotide
  modified_base (1)..(1): a, c, t, g, unknown or other
nggagtgggc

SEQ ID NO: 3326 - DNA, 10 bp, Artificial Sequence
  Description of Artificial Sequence: Synthetic oligonucleotide
  modified_base (1)..(1): a, c, t, g, unknown or other
nggagtgtgc

SEQ ID NO: 3327 - DNA, 10 bp, Artificial Sequence
  Description of Artificial Sequence: Synthetic oligonucleotide
  modified_base (1)..(1): a, c, t, g, unknown or other
nggagtgagg

SEQ ID NO: 3328 - DNA, 10 bp, Artificial Sequence
  Description of Artificial Sequence: Synthetic oligonucleotide
  modified_base (1)..(1): a, c, t, g, unknown or other
nggagtgcgg

SEQ ID NO: 3329 - DNA, 10 bp, Artificial Sequence
  Description of Artificial Sequence: Synthetic oligonucleotide
aggagtgggc

SEQ ID NO: 3330 - DNA, 10 bp, Artificial Sequence
  Description of Artificial Sequence: Synthetic oligonucleotide
aggagtgtgc

SEQ ID NO: 3331 - DNA, 10 bp, Artificial Sequence
  Description of Artificial Sequence: Synthetic oligonucleotide
aggagtgagg

SEQ ID NO: 3332 - DNA, 10 bp, Artificial Sequence
  Description of Artificial Sequence: Synthetic oligonucleotide
aggagtgcgg

SEQ ID NO: 3333 - DNA, 10 bp, Artificial Sequence
  Description of Artificial Sequence: Synthetic oligonucleotide
cggagtgggc

SEQ ID NO: 3334 - DNA, 10 bp, Artificial Sequence
  Description of Artificial Sequence: Synthetic oligonucleotide
cggagtgtgc

SEQ ID NO: 3335 - DNA, 10 bp, Artificial Sequence
  Description of Artificial Sequence: Synthetic oligonucleotide
cggagtgagg

SEQ ID NO: 3336 - DNA, 10 bp, Artificial Sequence
  Description of Artificial Sequence: Synthetic oligonucleotide
cggagtgcgg

SEQ ID NO: 3337 - DNA, 10 bp, Artificial Sequence
  Description of Artificial Sequence: Synthetic oligonucleotide
gggagtgggc

SEQ ID NO: 3338 - DNA, 10 bp, Artificial Sequence
  Description of Artificial Sequence: Synthetic oligonucleotide
gggagtgtgc

SEQ ID NO: 3339 - DNA, 10 bp, Artificial Sequence
  Description of Artificial Sequence: Synthetic oligonucleotide
gggagtgagg

SEQ ID NO: 3340 - DNA, 10 bp, Artificial Sequence
  Description of Artificial Sequence: Synthetic oligonucleotide
gggagtgcgg

SEQ ID NO: 3341 - DNA, 10 bp, Artificial Sequence
  Description of Artificial Sequence: Synthetic oligonucleotide
tggagtgggc

SEQ ID NO: 3342 - DNA, 10 bp, Artificial Sequence
  Description of Artificial Sequence: Synthetic oligonucleotide
tggagtgtgc

SEQ ID NO: 3343 - DNA, 10 bp, Artificial Sequence
  Description of Artificial Sequence: Synthetic oligonucleotide
tggagtgagg

SEQ ID NO: 3344 - DNA, 10 bp, Artificial Sequence
  Description of Artificial Sequence: Synthetic oligonucleotide
tggagtgcgg

SEQ ID NO: 3345 - DNA, 10 bp, Artificial Sequence
  Description of Artificial Sequence: Synthetic oligonucleotide
  modified_base (2)..(2): a, c, t, g, unknown or other
tngagtgggc

SEQ ID NO: 3346 - DNA, 10 bp, Artificial Sequence
  Description of Artificial Sequence: Synthetic oligonucleotide
  modified_base (2)..(2): a, c, t, g, unknown or other
tngagtgtgc

SEQ ID NO: 3347 - DNA, 10 bp, Artificial Sequence
  Description of Artificial Sequence: Synthetic oligonucleotide
  modified_base (2)..(2): a, c, t, g, unknown or other
tngagtgagg

SEQ ID NO: 3348 - DNA, 10 bp, Artificial Sequence
  Description of Artificial Sequence: Synthetic oligonucleotide
  modified_base (2)..(2): a, c, t, g, unknown or other
tngagtgcgg

SEQ ID NO: 3349 - DNA, 10 bp, Artificial Sequence
  Description of Artificial Sequence: Synthetic oligonucleotide
  modified_base (1)..(1): a, c, t, g, unknown or other
ntgagtgggc

SEQ ID NO: 3350 - DNA, 10 bp, Artificial Sequence
  Description of Artificial Sequence: Synthetic oligonucleotide
  modified_base (1)..(1): a, c, t, g, unknown or other
ntgagtgtgc

SEQ ID NO: 3351 - DNA, 10 bp, Artificial Sequence
  Description of Artificial Sequence: Synthetic oligonucleotide
  modified_base (1)..(1): a, c, t, g, unknown or other
ntgagtgagg

SEQ ID NO: 3352 - DNA, 10 bp, Artificial Sequence
  Description of Artificial Sequence: Synthetic oligonucleotide
  modified_base (1)..(1): a, c, t, g, unknown or other
ntgagtgcgg

SEQ ID NO: 3353 - DNA, 10 bp, Artificial Sequence
  Description of Artificial Sequence: Synthetic oligonucleotide
atgagtgggc

SEQ ID NO: 3354 - DNA, 10 bp, Artificial Sequence
  Description of Artificial Sequence: Synthetic oligonucleotide
atgagtgtgc

SEQ ID NO: 3355 - DNA, 10 bp, Artificial Sequence
  Description of Artificial Sequence: Synthetic oligonucleotide
atgagtgagg

SEQ ID NO: 3356 - DNA, 10 bp, Artificial Sequence
  Description of Artificial Sequence: Synthetic oligonucleotide
atgagtgcgg

SEQ ID NO: 3357 - DNA, 10 bp, Artificial Sequence
  Description of Artificial Sequence: Synthetic oligonucleotide
ctgagtgggc

SEQ ID NO: 3358 - DNA, 10 bp, Artificial Sequence
  Description of Artificial Sequence: Synthetic oligonucleotide
ctgagtgtgc

SEQ ID NO: 3359 - DNA, 10 bp, Artificial Sequence
  Description of Artificial Sequence: Synthetic oligonucleotide
ctgagtgagg

SEQ ID NO: 3360 - DNA, 10 bp, Artificial Sequence
  Description of Artificial Sequence: Synthetic oligonucleotide
ctgagtgcgg

SEQ ID NO: 3361 - DNA, 10 bp, Artificial Sequence
  Description of Artificial Sequence: Synthetic oligonucleotide
gtgagtgggc

SEQ ID NO: 3362 - DNA, 10 bp, Artificial Sequence
  Description of Artificial Sequence: Synthetic oligonucleotide
gtgagtgtgc

SEQ ID NO: 3363 - DNA, 10 bp, Artificial Sequence
  Description of Artificial Sequence: Synthetic oligonucleotide
gtgagtgagg

SEQ ID NO: 3364 - DNA, 10 bp, Artificial Sequence
  Description of Artificial Sequence: Synthetic oligonucleotide
gtgagtgcgg

SEQ ID NO: 3365 - DNA, 10 bp, Artificial Sequence
  Description of Artificial Sequence: Synthetic oligonucleotide
ttgagtgggc

SEQ ID NO: 3366 - DNA, 10 bp, Artificial Sequence
  Description of Artificial Sequence: Synthetic oligonucleotide
ttgagtgtgc

SEQ ID NO: 3367 - DNA, 10 bp, Artificial Sequence
  Description of Artificial Sequence: Synthetic oligonucleotide
ttgagtgagg

SEQ ID NO: 3368 - DNA, 10 bp, Artificial Sequence
  Description of Artificial Sequence: Synthetic oligonucleotide
ttgagtgcgg

SEQ ID NO: 3369 - DNA, 10 bp, Artificial Sequence
  Description of Artificial Sequence: Synthetic oligonucleotide
  modified_base (2)..(2): a, c, t, g, unknown or other
angagtgggg

SEQ ID NO: 3370 - DNA, 10 bp, Artificial Sequence
  Description of Artificial Sequence: Synthetic oligonucleotide
  modified_base (2)..(2): a, c, t, g, unknown or other
angagtgtgg

SEQ ID NO: 3371 - DNA, 10 bp, Artificial Sequence
  Description of Artificial Sequence: Synthetic oligonucleotide
  modified_base (2)..(2): a, c, t, g, unknown or other
angagtgagt

SEQ ID NO: 3372 - DNA, 10 bp, Artificial Sequence
  Description of Artificial Sequence: Synthetic oligonucleotide
  modified_base (2)..(2): a, c, t, g, unknown or other
angagtgcgt

SEQ ID NO: 3373 - DNA, 10 bp, Artificial Sequence
  Description of Artificial Sequence: Synthetic oligonucleotide
  modified_base (1)..(1): a, c, t, g, unknown or other
nagagtgggg

SEQ ID NO: 3374 - DNA, 10 bp, Artificial Sequence
  Description of Artificial Sequence: Synthetic oligonucleotide
  modified_base (1)..(1): a, c, t, g, unknown or other
nagagtgtgg

SEQ ID NO: 3375 - DNA, 10 bp, Artificial Sequence
  Description of Artificial Sequence: Synthetic oligonucleotide
  modified_base (1)..(1): a, c, t, g, unknown or other
nagagtgagt

SEQ ID NO: 3376 - DNA, 10 bp, Artificial Sequence
  Description of Artificial Sequence: Synthetic oligonucleotide
  modified_base (1)..(1): a, c, t, g, unknown or other
nagagtgcgt

SEQ ID NO: 3377 - DNA, 10 bp, Artificial Sequence
  Description of Artificial Sequence: Synthetic oligonucleotide
aagagtgggg

SEQ ID NO: 3378 - DNA, 10 bp, Artificial Sequence
  Description of Artificial Sequence: Synthetic oligonucleotide
aagagtgtgg

SEQ ID NO: 3379 - DNA, 10 bp, Artificial Sequence
  Description of Artificial Sequence: Synthetic oligonucleotide
aagagtgagt

SEQ ID NO: 3380 - DNA, 10 bp, Artificial Sequence
  Description of Artificial Sequence: Synthetic oligonucleotide
aagagtgcgt

SEQ ID NO: 3381 - DNA, 10 bp, Artificial Sequence
  Description of Artificial Sequence: Synthetic oligonucleotide
cagagtgggg

SEQ ID NO: 3382 - DNA, 10 bp, Artificial Sequence
  Description of Artificial Sequence: Synthetic oligonucleotide
cagagtgtgg

SEQ ID NO: 3383 - DNA, 10 bp, Artificial Sequence
  Description of Artificial Sequence: Synthetic oligonucleotide
cagagtgagt

SEQ ID NO: 3384 - DNA, 10 bp, Artificial Sequence
  Description of Artificial Sequence: Synthetic oligonucleotide
cagagtgcgt

SEQ ID NO: 3385 - DNA, 10 bp, Artificial Sequence
  Description of Artificial Sequence: Synthetic oligonucleotide
gagagtgggg

SEQ ID NO: 3386 - DNA, 10 bp, Artificial Sequence
  Description of Artificial Sequence: Synthetic oligonucleotide
gagagtgtgg

SEQ ID NO: 3387 - DNA, 10 bp, Artificial Sequence
  Description of Artificial Sequence: Synthetic oligonucleotide
gagagtgagt

SEQ ID NO: 3388 - DNA, 10 bp, Artificial Sequence
  Description of Artificial Sequence: Synthetic oligonucleotide
gagagtgcgt

SEQ ID NO: 3389 - DNA, 10 bp, Artificial Sequence
  Description of Artificial Sequence: Synthetic oligonucleotide
tagagtgggg

SEQ ID NO: 3390 - DNA, 10 bp, Artificial Sequence
  Description of Artificial Sequence: Synthetic oligonucleotide
tagagtgtgg

SEQ ID NO: 3391 - DNA, 10 bp, Artificial Sequence
  Description of Artificial Sequence: Synthetic oligonucleotide
tagagtgagt

SEQ ID NO: 3392 - DNA, 10 bp, Artificial Sequence
  Description of Artificial Sequence: Synthetic oligonucleotide
tagagtgcgt

SEQ ID NO: 3393 - DNA, 10 bp, Artificial Sequence
  Description of Artificial Sequence: Synthetic oligonucleotide
  modified_base (2)..(2): a, c, t, g, unknown or other
cngagtgggg

SEQ ID NO: 3394 - DNA, 10 bp, Artificial Sequence
  Description of Artificial Sequence: Synthetic oligonucleotide
  modified_base (2)..(2): a, c, t, g, unknown or other
cngagtgtgg

SEQ ID NO: 3395 - DNA, 10 bp, Artificial Sequence
  Description of Artificial Sequence: Synthetic oligonucleotide
  modified_base (2)..(2): a, c, t, g, unknown or other
cngagtgagt

SEQ ID NO: 3396 - DNA, 10 bp, Artificial Sequence
  Description of Artificial Sequence: Synthetic oligonucleotide
  modified_base (2)..(2): a, c, t, g, unknown or other
cngagtgcgt

SEQ ID NO: 3397 - DNA, 10 bp, Artificial Sequence
  Description of Artificial Sequence: Synthetic oligonucleotide
  modified_base (1)..(1): a, c, t, g, unknown or other
ncgagtgggg

SEQ ID NO: 3398 - DNA, 10 bp, Artificial Sequence
  Description of Artificial Sequence: Synthetic oligonucleotide
  modified_base (1)..(1): a, c, t, g, unknown or other
ncgagtgtgg

SEQ ID NO: 3399 - DNA, 10 bp, Artificial Sequence
  Description of Artificial Sequence: Synthetic oligonucleotide
  modified_base (1)..(1): a, c, t, g, unknown or other
ncgagtgagt

SEQ ID NO: 3400 - DNA, 10 bp, Artificial Sequence
  Description of Artificial Sequence: Synthetic oligonucleotide
  modified_base (1)..(1): a, c, t, g, unknown or other
ncgagtgcgt

SEQ ID NO: 3401 - DNA, 10 bp, Artificial Sequence
  Description of Artificial Sequence: Synthetic oligonucleotide
acgagtgggg

SEQ ID NO: 3402 - DNA, 10 bp, Artificial Sequence
  Description of Artificial Sequence: Synthetic oligonucleotide
acgagtgtgg

SEQ ID NO: 3403 - DNA, 10 bp, Artificial Sequence
  Description of Artificial Sequence: Synthetic oligonucleotide
acgagtgagt

SEQ ID NO: 3404 - DNA, 10 bp, Artificial Sequence
  Description of Artificial Sequence: Synthetic oligonucleotide
acgagtgcgt

SEQ ID NO: 3405 - DNA, 10 bp, Artificial Sequence
  Description of Artificial Sequence: Synthetic oligonucleotide
ccgagtgggg

SEQ ID NO: 3406 - DNA, 10 bp, Artificial Sequence
  Description of Artificial Sequence: Synthetic oligonucleotide
ccgagtgtgg

SEQ ID NO: 3407 - DNA, 10 bp, Artificial Sequence
  Description of Artificial Sequence: Synthetic oligonucleotide
ccgagtgagt

SEQ ID NO: 3408 - DNA, 10 bp, Artificial Sequence
  Description of Artificial Sequence: Synthetic oligonucleotide
ccgagtgcgt

SEQ ID NO: 3409 - DNA, 10 bp, Artificial Sequence
  Description of Artificial Sequence: Synthetic oligonucleotide
gcgagtgggg

SEQ ID NO: 3410 - DNA, 10 bp, Artificial Sequence
  Description of Artificial Sequence: Synthetic oligonucleotide
gcgagtgtgg

SEQ ID NO: 3411 - DNA, 10 bp, Artificial Sequence
  Description of Artificial Sequence: Synthetic oligonucleotide
gcgagtgagt

SEQ ID NO: 3412 - DNA, 10 bp, Artificial Sequence
  Description of Artificial Sequence: Synthetic oligonucleotide
gcgagtgcgt

SEQ ID NO: 3413 - DNA, 10 bp, Artificial Sequence
  Description of Artificial Sequence: Synthetic oligonucleotide
tcgagtgggg

SEQ ID NO: 3414 - DNA, 10 bp, Artificial Sequence
  Description of Artificial Sequence: Synthetic oligonucleotide
tcgagtgtgg

SEQ ID NO: 3415 - DNA, 10 bp, Artificial Sequence
  Description of Artificial Sequence: Synthetic oligonucleotide
tcgagtgagt

SEQ ID NO: 3416 - DNA, 10 bp, Artificial Sequence
  Description of Artificial Sequence: Synthetic oligonucleotide
tcgagtgcgt

SEQ ID NO: 3417 - DNA, 10 bp, Artificial Sequence
  Description of Artificial Sequence: Synthetic oligonucleotide
  modified_base (2)..(2): a, c, t, g, unknown or other
gngagtgggg

SEQ ID NO: 3418 - DNA, 10 bp, Artificial Sequence
  Description of Artificial Sequence: Synthetic oligonucleotide
  modified_base (2)..(2): a, c, t, g, unknown or other
gngagtgtgg

SEQ ID NO: 3419 - DNA, 10 bp, Artificial Sequence
  Description of Artificial Sequence: Synthetic oligonucleotide
  modified_base (2)..(2): a, c, t, g, unknown or other
gngagtgagt

SEQ ID NO: 3420 - DNA, 10 bp, Artificial Sequence
  Description of Artificial Sequence: Synthetic oligonucleotide
  modified_base (2)..(2): a, c, t, g, unknown or other
gngagtgcgt

SEQ ID NO: 3421 - DNA, 10 bp, Artificial Sequence
  Description of Artificial Sequence: Synthetic oligonucleotide
  modified_base (1)..(1): a, c, t, g, unknown or other
nggagtgggg

SEQ ID NO: 3422 - DNA, 10 bp, Artificial Sequence
  Description of Artificial Sequence: Synthetic oligonucleotide
  modified_base (1)..(1): a, c, t, g, unknown or other
nggagtgtgg

SEQ ID NO: 3423 - DNA, 10 bp, Artificial Sequence
  Description of Artificial Sequence: Synthetic oligonucleotide
  modified_base (1)..(1): a, c, t, g, unknown or other
nggagtgagt

SEQ ID NO: 3424 - DNA, 10 bp, Artificial Sequence
  Description of Artificial Sequence: Synthetic oligonucleotide
  modified_base (1)..(1): a, c, t, g, unknown or other
nggagtgcgt

SEQ ID NO: 3425 - DNA, 10 bp, Artificial Sequence
  Description of Artificial Sequence: Synthetic oligonucleotide
aggagtgggg

SEQ ID NO: 3426 - DNA, 10 bp, Artificial Sequence
  Description of Artificial Sequence: Synthetic oligonucleotide
aggagtgtgg

SEQ ID NO: 3427 - DNA, 10 bp, Artificial Sequence
  Description of Artificial Sequence: Synthetic oligonucleotide
aggagtgagt

SEQ ID NO: 3428 - DNA, 10 bp, Artificial Sequence
  Description of Artificial Sequence: Synthetic oligonucleotide
aggagtgcgt

SEQ ID NO: 3429 - DNA, 10 bp, Artificial Sequence
  Description of Artificial Sequence: Synthetic oligonucleotide
cggagtgggg

SEQ ID NO: 3430 - DNA, 10 bp, Artificial Sequence
  Description of Artificial Sequence: Synthetic oligonucleotide
cggagtgtgg

SEQ ID NO: 3431 - DNA, 10 bp, Artificial Sequence
  Description of Artificial Sequence: Synthetic oligonucleotide
cggagtgagt

SEQ ID NO: 3432 - DNA, 10 bp, Artificial Sequence
  Description of Artificial Sequence: Synthetic oligonucleotide
cggagtgcgt

SEQ ID NO: 3433 - DNA, 10 bp, Artificial Sequence
  Description of Artificial Sequence: Synthetic oligonucleotide
gggagtgggg

SEQ ID NO: 3434 - DNA, 10 bp, Artificial Sequence
  Description of Artificial Sequence: Synthetic oligonucleotide
gggagtgtgg

SEQ ID NO: 3435 - DNA, 10 bp, Artificial Sequence
  Description of Artificial Sequence: Synthetic oligonucleotide
gggagtgagt

SEQ ID NO: 3436 - DNA, 10 bp, Artificial Sequence
  Description of Artificial Sequence: Synthetic oligonucleotide
gggagtgcgt

SEQ ID NO: 3437 - DNA, 10 bp, Artificial Sequence
  Description of Artificial Sequence: Synthetic oligonucleotide
tggagtgggg

SEQ ID NO: 3438 - DNA, 10 bp, Artificial Sequence
  Description of Artificial Sequence: Synthetic oligonucleotide
tggagtgtgg

SEQ ID NO: 3439 - DNA, 10 bp, Artificial Sequence
  Description of Artificial Sequence: Synthetic oligonucleotide
tggagtgagt

SEQ ID NO: 3440 - DNA, 10 bp, Artificial Sequence
  Description of Artificial Sequence: Synthetic oligonucleotide
tggagtgcgt

SEQ ID NO: 3441 - DNA, 10 bp, Artificial Sequence
  Description of Artificial Sequence: Synthetic oligonucleotide
  modified_base (2)..(2): a, c, t, g, unknown or other
tngagtgggg

SEQ ID NO: 3442 - DNA, 10 bp, Artificial Sequence
  Description of Artificial Sequence: Synthetic oligonucleotide
  modified_base (2)..(2): a, c, t, g, unknown or other
tngagtgtgg

SEQ ID NO: 3443 - DNA, 10 bp, Artificial Sequence
  Description of Artificial Sequence: Synthetic oligonucleotide
  modified_base (2)..(2): a, c, t, g, unknown or other
tngagtgagt

SEQ ID NO: 3444 - DNA, 10 bp, Artificial Sequence
  Description of Artificial Sequence: Synthetic oligonucleotide
  modified_base (2)..(2): a, c, t, g, unknown or other
tngagtgcgt

SEQ ID NO: 3445 - DNA, 10 bp, Artificial Sequence
  Description of Artificial Sequence: Synthetic oligonucleotide
  modified_base (1)..(1): a, c, t, g, unknown or other
ntgagtgggg

SEQ ID NO: 3446 - DNA, 10 bp, Artificial Sequence
  Description of Artificial Sequence: Synthetic oligonucleotide
  modified_base (1)..(1): a, c, t, g, unknown or other
ntgagtgtgg

SEQ ID NO: 3447 - DNA, 10 bp, Artificial Sequence
  Description of Artificial Sequence: Synthetic oligonucleotide
  modified_base (1)..(1): a, c, t, g, unknown or other
ntgagtgagt

SEQ ID NO: 3448 - DNA, 10 bp, Artificial Sequence
  Description of Artificial Sequence: Synthetic oligonucleotide
  modified_base (1)..(1): a, c, t, g, unknown or other
ntgagtgcgt

SEQ ID NO: 3449 - DNA, 10 bp, Artificial Sequence
  Description of Artificial Sequence: Synthetic oligonucleotide
atgagtgggg

SEQ ID NO: 3450 - DNA, 10 bp, Artificial Sequence
  Description of Artificial Sequence: Synthetic oligonucleotide
atgagtgtgg

SEQ ID NO: 3451 - DNA, 10 bp, Artificial Sequence
  Description of Artificial Sequence: Synthetic oligonucleotide
atgagtgagt

SEQ ID NO: 3452 - DNA, 10 bp, Artificial Sequence
  Description of Artificial Sequence: Synthetic oligonucleotide
atgagtgcgt

SEQ ID NO: 3453 - DNA, 10 bp, Artificial Sequence
  Description of Artificial Sequence: Synthetic oligonucleotide
ctgagtgggg

SEQ ID NO: 3454 - DNA, 10 bp, Artificial Sequence
  Description of Artificial Sequence: Synthetic oligonucleotide
ctgagtgtgg

SEQ ID NO: 3455 - DNA, 10 bp, Artificial Sequence
  Description of Artificial Sequence: Synthetic oligonucleotide
ctgagtgagt

SEQ ID NO: 3456 - DNA, 10 bp, Artificial Sequence
  Description of Artificial Sequence: Synthetic oligonucleotide
ctgagtgcgt

SEQ ID NO: 3457 - DNA, 10 bp, Artificial Sequence
  Description of Artificial Sequence: Synthetic oligonucleotide
gtgagtgggg

SEQ ID NO: 3458 - DNA, 10 bp, Artificial Sequence
  Description of Artificial Sequence: Synthetic oligonucleotide
gtgagtgtgg

SEQ ID NO: 3459 - DNA, 10 bp, Artificial Sequence
  Description of Artificial Sequence: Synthetic oligonucleotide
gtgagtgagt

SEQ ID NO: 3460 - DNA, 10 bp, Artificial Sequence
  Description of Artificial Sequence: Synthetic oligonucleotide
gtgagtgcgt

SEQ ID NO: 3461 - DNA, 10 bp, Artificial Sequence
  Description of Artificial Sequence: Synthetic oligonucleotide
ttgagtgggg

SEQ ID NO: 3462 - DNA, 10 bp, Artificial Sequence
  Description of Artificial Sequence: Synthetic oligonucleotide
ttgagtgtgg

SEQ ID NO: 3463 - DNA, 10 bp, Artificial Sequence
  Description of Artificial Sequence: Synthetic oligonucleotide
ttgagtgagt

SEQ ID NO: 3464 - DNA, 10 bp, Artificial Sequence
  Description of Artificial Sequence: Synthetic oligonucleotide
ttgagtgcgt

SEQ ID NO: 3465 - DNA, 10 bp, Artificial Sequence
  Description of Artificial Sequence: Synthetic oligonucleotide
  modified_base (2)..(2): a, c, t, g, unknown or other
angagtgggt

SEQ ID NO: 3466 - DNA, 10 bp, Artificial Sequence
  Description of Artificial Sequence: Synthetic oligonucleotide
  modified_base (2)..(2): a, c, t, g, unknown or other
angagtgtgt

SEQ ID NO: 3467 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
angagtgnga

SEQ ID NO: 3468 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
angagtgngc

SEQ ID NO: 3469 - DNA, 10 bp, Artificial Sequence
  Description of Artificial Sequence: Synthetic oligonucleotide
  modified_base (1)..(1): a, c, t, g, unknown or other
nagagtgggt

SEQ ID NO: 3470 - DNA, 10 bp, Artificial Sequence
  Description of Artificial Sequence: Synthetic oligonucleotide
  modified_base (1)..(1): a, c, t, g, unknown or other
nagagtgtgt

SEQ ID NO: 3471 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
nagagtgnga

SEQ ID NO: 3472 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
nagagtgngc

SEQ ID NO: 3473 - DNA, 10 bp, Artificial Sequence
  Description of Artificial Sequence: Synthetic oligonucleotide
aagagtgggt

SEQ ID NO: 3474 - DNA, 10 bp, Artificial Sequence
  Description of Artificial Sequence: Synthetic oligonucleotide
aagagtgtgt

SEQ ID NO: 3475 - DNA, 10 bp, Artificial Sequence
  Description of Artificial Sequence: Synthetic oligonucleotide
  modified_base (8)..(8): a, c, t, g, unknown or other
aagagtgnga

SEQ ID NO: 3476 - DNA, 10 bp, Artificial Sequence
  Description of Artificial Sequence: Synthetic oligonucleotide
  modified_base (8)..(8): a, c, t, g, unknown or other
aagagtgngc

SEQ ID NO: 3477 - DNA, 10 bp, Artificial Sequence
  Description of Artificial Sequence: Synthetic oligonucleotide
cagagtgggt

SEQ ID NO: 3478 - DNA, 10 bp, Artificial Sequence
  Description of Artificial Sequence: Synthetic oligonucleotide
cagagtgtgt

SEQ ID NO: 3479 - DNA, 10 bp, Artificial Sequence
  Description of Artificial Sequence: Synthetic oligonucleotide
  modified_base (8)..(8): a, c, t, g, unknown or other
cagagtgnga

SEQ ID NO: 3480 - DNA, 10 bp, Artificial Sequence
  Description of Artificial Sequence: Synthetic oligonucleotide
  modified_base (8)..(8): a, c, t, g, unknown or other
cagagtgngc

SEQ ID NO: 3481 - DNA, 10 bp, Artificial Sequence
  Description of Artificial Sequence: Synthetic oligonucleotide
gagagtgggt

SEQ ID NO: 3482 - DNA, 10 bp, Artificial Sequence
  Description of Artificial Sequence: Synthetic oligonucleotide
gagagtgtgt

SEQ ID NO: 3483 - DNA, 10 bp, Artificial Sequence
  Description of Artificial Sequence: Synthetic oligonucleotide
  modified_base (8)..(8): a, c, t, g, unknown or other
gagagtgnga

SEQ ID NO: 3484 - DNA, 10 bp, Artificial Sequence
  Description of Artificial Sequence: Synthetic oligonucleotide
  modified_base (8)..(8): a, c, t, g, unknown or other
gagagtgngc

SEQ ID NO: 3485 - DNA, 10 bp, Artificial Sequence
  Description of Artificial Sequence: Synthetic oligonucleotide
tagagtgggt

SEQ ID NO: 3486 - DNA, 10 bp, Artificial Sequence
  Description of Artificial Sequence: Synthetic oligonucleotide
tagagtgtgt

SEQ ID NO: 3487 - DNA, 10 bp, Artificial Sequence
  Description of Artificial Sequence: Synthetic oligonucleotide
  modified_base (8)..(8): a, c, t, g, unknown or other
tagagtgnga

SEQ ID NO: 3488 - DNA, 10 bp, Artificial Sequence
  Description of Artificial Sequence: Synthetic oligonucleotide
  modified_base (8)..(8): a, c, t, g, unknown or other
tagagtgngc

SEQ ID NO: 3489 - DNA, 10 bp, Artificial Sequence
  Description of Artificial Sequence: Synthetic oligonucleotide
  modified_base (2)..(2): a, c, t, g, unknown or other
cngagtgggt

SEQ ID NO: 3490 - DNA, 10 bp, Artificial Sequence
  Description of Artificial Sequence: Synthetic oligonucleotide
  modified_base (2)..(2): a, c, t, g, unknown or other
cngagtgtgt

SEQ ID NO: 3491 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
cngagtgnga

SEQ ID NO: 3492 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
cngagtgngc

SEQ ID NO: 3493 - DNA, 10 bp, Artificial Sequence
  Description of Artificial Sequence: Synthetic oligonucleotide
  modified_base (1)..(1): a, c, t, g, unknown or other
ncgagtgggt

SEQ ID NO: 3494 - DNA, 10 bp, Artificial Sequence
  Description of Artificial Sequence: Synthetic oligonucleotide
  modified_base (1)..(1): a, c, t, g, unknown or other
ncgagtgtgt

SEQ ID NO: 3495 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
ncgagtgnga

SEQ ID NO: 3496 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
ncgagtgngc

SEQ ID NO: 3497 - DNA, 10 bp, Artificial Sequence
  Description of Artificial Sequence: Synthetic oligonucleotide
acgagtgggt

SEQ ID NO: 3498 - DNA, 10 bp, Artificial Sequence
  Description of Artificial Sequence: Synthetic oligonucleotide
acgagtgtgt

SEQ ID NO: 3499 - DNA, 10 bp, Artificial Sequence
  Description of Artificial Sequence: Synthetic oligonucleotide
  modified_base (8)..(8): a, c, t, g, unknown or other
acgagtgnga

SEQ ID NO: 3500 - DNA, 10 bp, Artificial Sequence
  Description of Artificial Sequence: Synthetic oligonucleotide
  modified_base (8)..(8): a, c, t, g, unknown or other
acgagtgngc

SEQ ID NO: 3501 - DNA, 10 bp, Artificial Sequence
  Description of Artificial Sequence: Synthetic oligonucleotide
ccgagtgggt

SEQ ID NO: 3502 - DNA, 10 bp, Artificial Sequence
  Description of Artificial Sequence: Synthetic oligonucleotide
ccgagtgtgt

SEQ ID NO: 3503 - DNA, 10 bp, Artificial Sequence
  Description of Artificial Sequence: Synthetic oligonucleotide
  modified_base (8)..(8): a, c, t, g, unknown or other
ccgagtgnga

SEQ ID NO: 3504 - DNA, 10 bp, Artificial Sequence
  Description of Artificial Sequence: Synthetic oligonucleotide
  modified_base (8)..(8): a, c, t, g, unknown or other
ccgagtgngc

SEQ ID NO: 3505 - DNA, 10 bp, Artificial Sequence
  Description of Artificial Sequence: Synthetic oligonucleotide
gcgagtgggt

SEQ ID NO: 3506 - DNA, 10 bp, Artificial Sequence
  Description of Artificial Sequence: Synthetic oligonucleotide
gcgagtgtgt

SEQ ID NO: 3507 - DNA, 10 bp, Artificial Sequence
  Description of Artificial Sequence: Synthetic oligonucleotide
  modified_base (8)..(8): a, c, t, g, unknown or other
gcgagtgnga

SEQ ID NO: 3508 - DNA, 10 bp, Artificial Sequence
  Description of Artificial Sequence: Synthetic oligonucleotide
  modified_base (8)..(8): a, c, t, g, unknown or other
gcgagtgngc

SEQ ID NO: 3509 - DNA, 10 bp, Artificial Sequence
  Description of Artificial Sequence: Synthetic oligonucleotide
tcgagtgggt

SEQ ID NO: 3510 - DNA, 10 bp, Artificial Sequence
  Description of Artificial Sequence: Synthetic oligonucleotide
tcgagtgtgt

SEQ ID NO: 3511 - DNA, 10 bp, Artificial Sequence
  Description of Artificial Sequence: Synthetic oligonucleotide
  modified_base (8)..(8): a, c, t, g, unknown or other
tcgagtgnga

SEQ ID NO: 3512 - DNA, 10 bp, Artificial Sequence
  Description of Artificial Sequence: Synthetic oligonucleotide
  modified_base (8)..(8): a, c, t, g, unknown or other
tcgagtgngc

SEQ ID NO: 3513 - DNA, 10 bp, Artificial Sequence
  Description of Artificial Sequence: Synthetic oligonucleotide
  modified_base (2)..(2): a, c, t, g, unknown or other
gngagtgggt

SEQ ID NO: 3514 - DNA, 10 bp, Artificial Sequence
  Description of Artificial Sequence: Synthetic oligonucleotide
  modified_base (2)..(2): a, c, t, g, unknown or other
gngagtgtgt

SEQ ID NO: 3515 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
gngagtgnga

SEQ ID NO: 3516 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
gngagtgngc

SEQ ID NO: 3517 - DNA, 10 bp, Artificial Sequence
  Description of Artificial Sequence: Synthetic oligonucleotide
  modified_base (1)..(1): a, c, t, g, unknown or other
nggagtgggt

SEQ ID NO: 3518 - DNA, 10 bp, Artificial Sequence
  Description of Artificial Sequence: Synthetic oligonucleotide
  modified_base (1)..(1): a, c, t, g, unknown or other
nggagtgtgt

SEQ ID NO: 3519 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
nggagtgnga

SEQ ID NO: 3520 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
nggagtgngc

SEQ ID NO: 3521 - DNA, 10 bp, Artificial Sequence
  Description of Artificial Sequence: Synthetic oligonucleotide
aggagtgggt

SEQ ID NO: 3522 - DNA, 10 bp, Artificial Sequence
  Description of Artificial Sequence: Synthetic oligonucleotide
aggagtgtgt

SEQ ID NO: 3523 - DNA, 10 bp, Artificial Sequence
  Description of Artificial Sequence: Synthetic oligonucleotide
  modified_base (8)..(8): a, c, t, g, unknown or other
aggagtgnga

SEQ ID NO: 3524 - DNA, 10 bp, Artificial Sequence
  Description of Artificial Sequence: Synthetic oligonucleotide
  modified_base (8)..(8): a, c, t, g, unknown or other
aggagtgngc

SEQ ID NO: 3525 - DNA, 10 bp, Artificial Sequence
  Description of Artificial Sequence: Synthetic oligonucleotide
cggagtgggt

SEQ ID NO: 3526 - DNA, 10 bp, Artificial Sequence
  Description of Artificial Sequence: Synthetic oligonucleotide
cggagtgtgt

SEQ ID NO: 3527 - DNA, 10 bp, Artificial Sequence
  Description of Artificial Sequence: Synthetic oligonucleotide
  modified_base (8)..(8): a, c, t, g, unknown or other
cggagtgnga

SEQ ID NO: 3528 - DNA, 10 bp, Artificial Sequence
  Description of Artificial Sequence: Synthetic oligonucleotide
  modified_base (8)..(8): a, c, t, g, unknown or other
cggagtgngc

SEQ ID NO: 3529 - DNA, 10 bp, Artificial Sequence
  Description of Artificial Sequence: Synthetic oligonucleotide
gggagtgggt

SEQ ID NO: 3530 - DNA, 10 bp, Artificial Sequence
  Description of Artificial Sequence: Synthetic oligonucleotide
gggagtgtgt

SEQ ID NO: 3531 - DNA, 10 bp, Artificial Sequence
  Description of Artificial Sequence: Synthetic oligonucleotide
  modified_base (8)..(8): a, c, t, g, unknown or other
gggagtgnga

SEQ ID NO: 3532 - DNA, 10 bp, Artificial Sequence
  Description of Artificial Sequence: Synthetic oligonucleotide
  modified_base (8)..(8): a, c, t, g, unknown or other
gggagtgngc

SEQ ID NO: 3533 - DNA, 10 bp, Artificial Sequence
  Description of Artificial Sequence: Synthetic oligonucleotide
tggagtgggt

SEQ ID NO: 3534 - DNA, 10 bp, Artificial Sequence
  Description of Artificial Sequence: Synthetic oligonucleotide
tggagtgtgt

SEQ ID NO: 3535 - DNA, 10 bp, Artificial Sequence
  Description of Artificial Sequence: Synthetic oligonucleotide
  modified_base (8)..(8): a, c, t, g, unknown or other
tggagtgnga

SEQ ID NO: 3536 - DNA, 10 bp, Artificial Sequence
  Description of Artificial Sequence: Synthetic oligonucleotide
  modified_base (8)..(8): a, c, t, g, unknown or other
tggagtgngc

SEQ ID NO: 3537 - DNA, 10 bp, Artificial Sequence
  Description of Artificial Sequence: Synthetic oligonucleotide
  modified_base (2)..(2): a, c, t, g, unknown or other
tngagtgggt

SEQ ID NO: 3538 - DNA, 10 bp, Artificial Sequence
  Description of Artificial Sequence: Synthetic oligonucleotide
  modified_base (2)..(2): a, c, t, g, unknown or other
tngagtgtgt

SEQ ID NO: 3539 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
tngagtgnga

SEQ ID NO: 3540 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
tngagtgngc

SEQ ID NO: 3541 - DNA, 10 bp, Artificial Sequence
  Description of Artificial Sequence: Synthetic oligonucleotide
  modified_base (1)..(1): a, c, t, g, unknown or other
ntgagtgggt

SEQ ID NO: 3542 - DNA, 10 bp, Artificial Sequence
  Description of Artificial Sequence: Synthetic oligonucleotide
  modified_base (1)..(1): a, c, t, g, unknown or other
ntgagtgtgt

SEQ ID NO: 3543 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
ntgagtgnga

SEQ ID NO: 3544 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
ntgagtgngc

SEQ ID NO: 3545 - DNA, 10 bp, Artificial Sequence
  Description of Artificial Sequence: Synthetic oligonucleotide
atgagtgggt

SEQ ID NO: 3546 - DNA, 10 bp, Artificial Sequence
  Description of Artificial Sequence: Synthetic oligonucleotide
atgagtgtgt

SEQ ID NO: 3547 - DNA, 10 bp, Artificial Sequence
  Description of Artificial Sequence: Synthetic oligonucleotide
  modified_base (8)..(8): a, c, t, g, unknown or other
atgagtgnga

SEQ ID NO: 3548 - DNA, 10 bp, Artificial Sequence
  Description of Artificial Sequence: Synthetic oligonucleotide
  modified_base (8)..(8): a, c, t, g, unknown or other
atgagtgngc

SEQ ID NO: 3549 - DNA, 10 bp, Artificial Sequence
  Description of Artificial Sequence: Synthetic oligonucleotide
ctgagtgggt

SEQ ID NO: 3550 - DNA, 10 bp, Artificial Sequence
  Description of Artificial Sequence: Synthetic oligonucleotide
ctgagtgtgt

SEQ ID NO: 3551 - DNA, 10 bp, Artificial Sequence
  Description of Artificial Sequence: Synthetic oligonucleotide
  modified_base (8)..(8): a, c, t, g, unknown or other
ctgagtgnga

SEQ ID NO: 3552 - DNA, 10 bp, Artificial Sequence
  Description of Artificial Sequence: Synthetic oligonucleotide
  modified_base (8)..(8): a, c, t, g, unknown or other
ctgagtgngc

SEQ ID NO: 3553 - DNA, 10 bp, Artificial Sequence
  Description of Artificial Sequence: Synthetic oligonucleotide
gtgagtgggt

SEQ ID NO: 3554 - DNA, 10 bp, Artificial Sequence
  Description of Artificial Sequence: Synthetic oligonucleotide
gtgagtgtgt

SEQ ID NO: 3555 - DNA, 10 bp, Artificial Sequence
  Description of Artificial Sequence: Synthetic oligonucleotide
  modified_base (8)..(8): a, c, t, g, unknown or other
gtgagtgnga

SEQ ID NO: 3556 - DNA, 10 bp, Artificial Sequence
  Description of Artificial Sequence: Synthetic oligonucleotide
  modified_base (8)..(8): a, c, t, g, unknown or other
gtgagtgngc

SEQ ID NO: 3557 - DNA, 10 bp, Artificial Sequence
  Description of Artificial Sequence: Synthetic oligonucleotide
ttgagtgggt

SEQ ID NO: 3558 - DNA, 10 bp, Artificial Sequence
  Description of Artificial Sequence: Synthetic oligonucleotide
ttgagtgtgt

SEQ ID NO: 3559 - DNA, 10 bp, Artificial Sequence
  Description of Artificial Sequence: Synthetic oligonucleotide
  modified_base (8)..(8): a, c, t, g, unknown or other
ttgagtgnga

SEQ ID NO: 3560 - DNA, 10 bp, Artificial Sequence
  Description of Artificial Sequence: Synthetic oligonucleotide
  modified_base (8)..(8): a, c, t, g, unknown or other
ttgagtgngc

SEQ ID NO: 3561 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
angagtgngg

SEQ ID NO: 3562 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
gngagtgngg

SEQ ID NO: 3563 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
angagtgngt

SEQ ID NO: 3564 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
gngagtgngt

SEQ ID NO: 3565 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
nagagtgngg

SEQ ID NO: 3566 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
nggagtgngg

SEQ ID NO: 3567 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
nagagtgngt

SEQ ID NO: 3568 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
nggagtgngt

SEQ ID NO: 3569 - DNA, 10 bp, Artificial Sequence
  Description of Artificial Sequence: Synthetic oligonucleotide
  modified_base (8)..(8): a, c, t, g, unknown or other
aagagtgngg

SEQ ID NO: 3570 - DNA, 10 bp, Artificial Sequence
  Description of Artificial Sequence: Synthetic oligonucleotide
  modified_base (8)..(8): a, c, t, g, unknown or other
aggagtgngg

SEQ ID NO: 3571 - DNA, 10 bp, Artificial Sequence
  Description of Artificial Sequence: Synthetic oligonucleotide
  modified_base (8)..(8): a, c, t, g, unknown or other
aagagtgngt

SEQ ID NO: 3572 - DNA, 10 bp, Artificial Sequence
  Description of Artificial Sequence: Synthetic oligonucleotide
  modified_base (8)..(8): a, c, t, g, unknown or other
aggagtgngt

SEQ ID NO: 3573 - DNA, 10 bp, Artificial Sequence
  Description of Artificial Sequence: Synthetic oligonucleotide
  modified_base (8)..(8): a, c, t, g, unknown or other
cagagtgngg

SEQ ID NO: 3574 - DNA, 10 bp, Artificial Sequence
  Description of Artificial Sequence: Synthetic oligonucleotide
  modified_base (8)..(8): a, c, t, g, unknown or other
cggagtgngg

SEQ ID NO: 3575 - DNA, 10 bp, Artificial Sequence
  Description of Artificial Sequence: Synthetic oligonucleotide
  modified_base (8)..(8): a, c, t, g, unknown or other
cagagtgngt

SEQ ID NO: 3576 - DNA, 10 bp, Artificial Sequence
  Description of Artificial Sequence: Synthetic oligonucleotide
  modified_base (8)..(8): a, c, t, g, unknown or other
cggagtgngt

SEQ ID NO: 3577 - DNA, 10 bp, Artificial Sequence
  Description of Artificial Sequence: Synthetic oligonucleotide
  modified_base (8)..(8): a, c, t, g, unknown or other
gagagtgngg

SEQ ID NO: 3578 - DNA, 10 bp, Artificial Sequence
  Description of Artificial Sequence: Synthetic oligonucleotide
  modified_base (8)..(8): a, c, t, g, unknown or other
gggagtgngg

SEQ ID NO: 3579 - DNA, 10 bp, Artificial Sequence
  Description of Artificial Sequence: Synthetic oligonucleotide
  modified_base (8)..(8): a, c, t, g, unknown or other
gagagtgngt

SEQ ID NO: 3580 - DNA, 10 bp, Artificial Sequence
  Description of Artificial Sequence: Synthetic oligonucleotide
  modified_base (8)..(8): a, c, t, g, unknown or other
gggagtgngt

SEQ ID NO: 3581 - DNA, 10 bp, Artificial Sequence
  Description of Artificial Sequence: Synthetic oligonucleotide
  modified_base (8)..(8): a, c, t, g, unknown or other
tagagtgngg

SEQ ID NO: 3582 - DNA, 10 bp, Artificial Sequence
  Description of Artificial Sequence: Synthetic oligonucleotide
  modified_base (8)..(8): a, c, t, g, unknown or other
tggagtgngg

SEQ ID NO: 3583 - DNA, 10 bp, Artificial Sequence
  Description of Artificial Sequence: Synthetic oligonucleotide
  modified_base (8)..(8): a, c, t, g, unknown or other
tagagtgngt

SEQ ID NO: 3584 - DNA, 10 bp, Artificial Sequence
  Description of Artificial Sequence: Synthetic oligonucleotide
  modified_base (8)..(8): a, c, t, g, unknown or other
tggagtgngt

SEQ ID NO: 3585 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
cngagtgngg

SEQ ID NO: 3586 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
tngagtgngg

SEQ ID NO: 3587 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
cngagtgngt

SEQ ID NO: 3588 - DNA, 10 bp, Artificial Sequence
  Description of Artificial Sequence: Synthetic oligonucleotide
  modified_base (2)..(2): a, c, t, g, unknown or other
  modified_base (8)..(8): a, c, t, g, unknown or other
tngagtgngt

SEQ ID NO: 3589 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
ncgagtgngg

SEQ ID NO: 3590 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
ntgagtgngg

SEQ ID NO: 3591 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
ncgagtgngt

SEQ ID NO: 3592 - DNA, 10 bp, Artificial Sequence
  Description of Artificial Sequence: Synthetic oligonucleotide
  modified_base (1)..(1): a, c, t, g, unknown or other
  modified_base (8)..(8): a, c, t, g, unknown or other
ntgagtgngt

SEQ ID NO: 3593 - DNA, 10 bp, Artificial Sequence
  Description of Artificial Sequence: Synthetic oligonucleotide
  modified_base (8)..(8): a, c, t, g, unknown or other
acgagtgngg

SEQ ID NO: 3594 - DNA, 10 bp, Artificial Sequence
  Description of Artificial Sequence: Synthetic oligonucleotide
  modified_base (8)..(8): a, c, t, g, unknown or other
atgagtgngg

SEQ ID NO: 3595 - DNA, 10 bp, Artificial Sequence
  Description of Artificial Sequence: Synthetic oligonucleotide
  modified_base (8)..(8): a, c, t, g, unknown or other
acgagtgngt

SEQ ID NO: 3596 - DNA, 10 bp, Artificial Sequence
  Description of Artificial Sequence: Synthetic oligonucleotide
  modified_base (8)..(8): a, c, t, g, unknown or other
atgagtgngt

SEQ ID NO: 3597 - DNA, 10 bp, Artificial Sequence
  Description of Artificial Sequence: Synthetic oligonucleotide
  modified_base (8)..(8): a, c, t, g, unknown or other
ccgagtgngg

SEQ ID NO: 3598 - DNA, 10 bp, Artificial Sequence
  Description of Artificial Sequence: Synthetic oligonucleotide
  modified_base (8)..(8): a, c, t, g, unknown or other
ctgagtgngg

SEQ ID NO: 3599 - DNA, 10 bp, Artificial Sequence
  Description of Artificial Sequence: Synthetic oligonucleotide
  modified_base (8)..(8): a, c, t, g, unknown or other
ccgagtgngt

SEQ ID NO: 3600 - DNA, 10 bp, Artificial Sequence
  Description of Artificial Sequence: Synthetic oligonucleotide
  modified_base (8)..(8): a, c, t, g, unknown or other
ctgagtgngt

SEQ ID NO: 3601 - DNA, 10 bp, Artificial Sequence
  Description of Artificial Sequence: Synthetic oligonucleotide
  modified_base (8)..(8): a, c, t, g, unknown or other
gcgagtgngg

SEQ ID NO: 3602 - DNA, 10 bp, Artificial Sequence
  Description of Artificial Sequence: Synthetic oligonucleotide
  modified_base (8)..(8): a, c, t, g, unknown or other
gtgagtgngg

SEQ ID NO: 3603 - DNA, 10 bp, Artificial Sequence
  Description of Artificial Sequence: Synthetic oligonucleotide
  modified_base (8)..(8): a, c, t, g, unknown or other
gcgagtgngt

SEQ ID NO: 3604 - DNA, 10 bp, Artificial Sequence
  Description of Artificial Sequence: Synthetic oligonucleotide
  modified_base (8)..(8): a, c, t, g, unknown or other
gtgagtgngt

SEQ ID NO: 3605 - DNA, 10 bp, Artificial Sequence
  Description of Artificial Sequence: Synthetic oligonucleotide
  modified_base (8)..(8): a, c, t, g, unknown or other
tcgagtgngg

SEQ ID NO: 3606 - DNA, 10 bp, Artificial Sequence
  Description of Artificial Sequence: Synthetic oligonucleotide
  modified_base (8)..(8): a, c, t, g, unknown or other
ttgagtgngg

SEQ ID NO: 3607 - DNA, 10 bp, Artificial Sequence
  Description of Artificial Sequence: Synthetic oligonucleotide
  modified_base (8)..(8): a, c, t, g, unknown or other
tcgagtgngt

SEQ ID NO: 3608 - DNA, 10 bp, Artificial Sequence
  Description of Artificial Sequence: Synthetic oligonucleotide
  modified_base (8)..(8): a, c, t, g, unknown or other
ttgagtgngt

SEQ ID NO: 3609 - DNA, 10 bp, Artificial Sequence
  Description of Artificial Sequence: Synthetic oligonucleotide
  Description of Combined DNA/RNA Molecule: Synthetic oligonucleotide
  modified_base (1)..(2): a, c, t, g, unknown or other
nngagtragu

SEQ ID NO: 3610 - DNA, 10 bp, Artificial Sequence
  Description of Artificial Sequence: Synthetic oligonucleotide
  Description of Combined DNA/RNA Molecule: Synthetic oligonucleotide
  modified_base (2)..(2): a, c, t, g, unknown or other
angagtragu

SEQ ID NO: 3611 - DNA, 10 bp, Artificial Sequence
  Description of Artificial Sequence: Synthetic oligonucleotide
  Description of Combined DNA/RNA Molecule: Synthetic oligonucleotide
  modified_base (2)..(2): a, c, t, g, unknown or other
cngagtragu

SEQ ID NO: 3612 - DNA, 10 bp, Artificial Sequence
  Description of Artificial Sequence: Synthetic oligonucleotide
  Description of Combined DNA/RNA Molecule: Synthetic oligonucleotide
  modified_base (2)..(2): a, c, t, g, unknown or other
gngagtragu

SEQ ID NO: 3613 - DNA, 10 bp, Artificial Sequence
  Description of Artificial Sequence: Synthetic oligonucleotide
  Description of Combined DNA/RNA Molecule: Synthetic oligonucleotide
  modified_base (2)..(2): a, c, t, g, unknown or other
tngagtragu

SEQ ID NO: 3614 - DNA, 10 bp, Artificial Sequence
  Description of Artificial Sequence: Synthetic oligonucleotide
  Description of Combined DNA/RNA Molecule: Synthetic oligonucleotide
  modified_base (1)..(1): a, c, t, g, unknown or other
nagagtragu

SEQ ID NO: 3615 - DNA, 10 bp, Artificial Sequence
  Description of Artificial Sequence: Synthetic oligonucleotide
  Description of Combined DNA/RNA Molecule: Synthetic oligonucleotide
  modified_base (1)..(1): a, c, t, g, unknown or other
ncgagtragu

SEQ ID NO: 3616 - DNA, 10 bp, Artificial Sequence
  Description of Artificial Sequence: Synthetic oligonucleotide
  Description of Combined DNA/RNA Molecule: Synthetic oligonucleotide
  modified_base (1)..(1): a, c, t, g, unknown or other
nggagtragu

SEQ ID NO: 3617 - DNA, 10 bp, Artificial Sequence
  Description of Artificial Sequence: Synthetic oligonucleotide
  Description of Combined DNA/RNA Molecule: Synthetic oligonucleotide
  modified_base (1)..(1): a, c, t, g, unknown or other
ntgagtragu

SEQ ID NO: 3618 - DNA, 10 bp, Artificial Sequence
  Description of Artificial Sequence: Synthetic oligonucleotide
  Description of Combined DNA/RNA Molecule: Synthetic oligonucleotide
aagagtragu

SEQ ID NO: 3619 - DNA, 10 bp, Artificial Sequence
  Description of Artificial Sequence: Synthetic oligonucleotide
  Description of Combined DNA/RNA Molecule: Synthetic oligonucleotide
acgagtragu

SEQ ID NO: 3620 - DNA, 10 bp, Artificial Sequence
  Description of Artificial Sequence: Synthetic oligonucleotide
  Description of Combined DNA/RNA Molecule: Synthetic oligonucleotide
aggagtragu

SEQ ID NO: 3621 - DNA, 10 bp, Artificial Sequence
  Description of Artificial Sequence: Synthetic oligonucleotide
  Description of Combined DNA/RNA Molecule: Synthetic oligonucleotide
atgagtragu

SEQ ID NO: 3622 - DNA, 10 bp, Artificial Sequence
  Description of Artificial Sequence: Synthetic oligonucleotide
  Description of Combined DNA/RNA Molecule: Synthetic oligonucleotide
cagagtragu

SEQ ID NO: 3623 - DNA, 10 bp, Artificial Sequence
  Description of Artificial Sequence: Synthetic oligonucleotide
  Description of Combined DNA/RNA Molecule: Synthetic oligonucleotide
ccgagtragu

SEQ ID NO: 3624 - DNA, 10 bp, Artificial Sequence
  Description of Artificial Sequence: Synthetic oligonucleotide
  Description of Combined DNA/RNA Molecule: Synthetic oligonucleotide
cggagtragu

SEQ ID NO: 3625 - DNA, 10 bp, Artificial Sequence
  Description of Artificial Sequence: Synthetic oligonucleotide
  Description of Combined DNA/RNA Molecule: Synthetic oligonucleotide
ctgagtragu

SEQ ID NO: 3626 - DNA, 10 bp, Artificial Sequence
  Description of Artificial Sequence: Synthetic oligonucleotide
  Description of Combined DNA/RNA Molecule: Synthetic oligonucleotide
gagagtragu

SEQ ID NO: 3627 - DNA, 10 bp, Artificial Sequence
  Description of Artificial Sequence: Synthetic oligonucleotide
  Description of Combined DNA/RNA Molecule: Synthetic oligonucleotide
gcgagtragu

SEQ ID NO: 3628 - DNA, 10 bp, Artificial Sequence
  Description of Artificial Sequence: Synthetic oligonucleotide
  Description of Combined DNA/RNA Molecule: Synthetic oligonucleotide
gggagtragu

SEQ ID NO: 3629 - DNA, 10 bp, Artificial Sequence
  Description of Artificial Sequence: Synthetic oligonucleotide
  Description of Combined DNA/RNA Molecule: Synthetic oligonucleotide
gtgagtragu

SEQ ID NO: 3630 - DNA, 10 bp, Artificial Sequence
  Description of Artificial Sequence: Synthetic oligonucleotide
  Description of Combined DNA/RNA Molecule: Synthetic oligonucleotide
tagagtragu

SEQ ID NO: 3631 - DNA, 10 bp, Artificial Sequence
  Description of Artificial Sequence: Synthetic oligonucleotide
  Description of Combined DNA/RNA Molecule: Synthetic oligonucleotide
tcgagtragu

SEQ ID NO: 3632 - DNA, 10 bp, Artificial Sequence
  Description of Artificial Sequence: Synthetic oligonucleotide
  Description of Combined DNA/RNA Molecule: Synthetic oligonucleotide
tggagtragu

SEQ ID NO: 3633 - DNA, 10 bp, Artificial Sequence
  Description of Artificial Sequence: Synthetic oligonucleotide
  Description of Combined DNA/RNA Molecule: Synthetic oligonucleotide
ttgagtragu

SEQ ID NO: 3634 - DNA, 10 bp, Artificial Sequence
  Description of Artificial Sequence: Synthetic oligonucleotide
  modified_base (1)..(2): a, c, t, g, unknown or other
nngagtragt

SEQ ID NO: 3635 - DNA, 20 bp, Artificial Sequence
  Description of Artificial Sequence: Synthetic primer
gccggcggctcctgttttac

SEQ ID NO: 3636 - DNA, 20 bp, Artificial Sequence
  Description of Artificial Sequence: Synthetic primer
agtcgctgtaccacgacatc

SEQ ID NO: 3637 - DNA, 20 bp, Artificial Sequence
  Description of Artificial Sequence: Synthetic primer
gctgccggatgtctgatctc

SEQ ID NO: 3638 - DNA, 23 bp, Artificial Sequence
  Description of Artificial Sequence: Synthetic primer
acgaattccaacttgtttcacgc

SEQ ID NO: 3639 - DNA, 20 bp, Artificial Sequence
  Description of Artificial Sequence: Synthetic primer
ttgaccatgcaatggtggct

SEQ ID NO: 3640 - DNA, 19 bp, Artificial Sequence
  Description of Artificial Sequence: Synthetic primer
gcccaggacttcggaacta

SEQ ID NO: 3641 - DNA, 20 bp, Artificial Sequence
  Description of Artificial Sequence: Synthetic primer
gatccgggacagcccttgta

SEQ ID NO: 3642 - DNA, 20 bp, Artificial Sequence
  Description of Artificial Sequence: Synthetic primer
cggcagagtctcagtccaat

SEQ ID NO: 3643 - DNA, 20 bp, Artificial Sequence
  Description of Artificial Sequence: Synthetic primer
ggcactgaggcaggaaaagc

SEQ ID NO: 3644 - DNA, 19 bp, Artificial Sequence
  Description of Artificial Sequence: Synthetic primer
gtcggcggagtagcaagtg

SEQ ID NO: 3645 - DNA, 20 bp, Artificial Sequence
  Description of Artificial Sequence: Synthetic primer
tgcccagtcatttgcacctt

SEQ ID NO: 3646 - DNA, 26 bp, Artificial Sequence
  Description of Artificial Sequence: Synthetic primer
tggtgtctaagaatgaggaaatggta

SEQ ID NO: 3647 - DNA, 22 bp, Artificial Sequence
  Description of Artificial Sequence: Synthetic primer
tttggggagtggataatcagca

SEQ ID NO: 3648 - DNA, 20 bp, Artificial Sequence
  Description of Artificial Sequence: Synthetic primer
cccggagcagtgatggtgat

SEQ ID NO: 3649 - DNA, 20 bp, Artificial Sequence
  Description of Artificial Sequence: Synthetic primer
tgtgccgtgtaccctgtaac

SEQ ID NO: 3650 - DNA, 23 bp, Artificial Sequence
  Description of Artificial Sequence: Synthetic primer
cgacatccacacctaatgtccac

SEQ ID NO: 3651 - DNA, 25 bp, Artificial Sequence
  Description of Artificial Sequence: Synthetic primer
tcagagtctaagagagatggaggtt

SEQ ID NO: 3652 - DNA, 22 bp, Artificial Sequence
  Description of Artificial Sequence: Synthetic primer
ctggttgatgagttggacagcc

SEQ ID NO: 3653 - DNA, 22 bp, Artificial Sequence
  Description of Artificial Sequence: Synthetic primer
acttaaccttgcagagagccac

SEQ ID NO: 3654 - DNA, 19 bp, Artificial Sequence
  Description of Artificial Sequence: Synthetic primer
gcctaaatagccgcagcct

SEQ ID NO: 3655 - DNA, 19 bp, Artificial Sequence
  Description of Artificial Sequence: Synthetic primer
gccagcaggaggctgatga

SEQ ID NO: 3656 - DNA, 20 bp, Artificial Sequence
  Description of Artificial Sequence: Synthetic primer
ttcacatctgatggctcccc

SEQ ID NO: 3657 - DNA, 24 bp, Artificial Sequence
  Description of Artificial Sequence: Synthetic primer
ccatttgtgtgtgatgattgttca

SEQ ID NO: 3658 - DNA, 20 bp, Artificial Sequence
  Description of Artificial Sequence: Synthetic primer
aggagctgcggtagccatca

SEQ ID NO: 3659 - DNA, 20 bp, Artificial Sequence
  Description of Artificial Sequence: Synthetic primer
gagccaccagtcactgttca

SEQ ID NO: 3660 - DNA, 20 bp, Artificial Sequence
  Description of Artificial Sequence: Synthetic primer
tgaggcctatgcaaaccagg

SEQ ID NO: 3661 - DNA, 23 bp, Artificial Sequence
  Description of Artificial Sequence: Synthetic primer
caaggaagagctgaacttgatgc

SEQ ID NO: 3662 - DNA, 21 bp, Artificial Sequence
  Description of Artificial Sequence: Synthetic primer
actgcctcctgtgtcttcaat

SEQ ID NO: 3663 - DNA, 21 bp, Artificial Sequence
  Description of Artificial Sequence: Synthetic primer
tgactggcattctcttgaaca

SEQ ID NO: 3664 - DNA, 24 bp, Artificial Sequence
  Description of Artificial Sequence: Synthetic primer
ccatacttttcaacagttcctggt

SEQ ID NO: 3665 - DNA, 20 bp, Artificial Sequence
  Description of Artificial Sequence: Synthetic primer
gcgactggagtccttgttga

SEQ ID NO: 3666 - DNA, 22 bp, Artificial Sequence
  Description of Artificial Sequence: Synthetic primer
aggaagaaggtcaaggaggcac

SEQ ID NO: 3667 - DNA, 23 bp, Artificial Sequence
  Description of Artificial Sequence: Synthetic primer
cagagcttctggtaagccttaga

SEQ ID NO: 3668 - DNA, 20 bp, Artificial Sequence
  Description of Artificial Sequence: Synthetic primer
gggtatttgtccttctttct

SEQ ID NO: 3669 - DNA, 23 bp, Artificial Sequence
  Description of Artificial Sequence: Synthetic primer
cgcaagttgtgagaaaggcacta

SEQ ID NO: 3670 - DNA, 24 bp, Artificial Sequence
  Description of Artificial Sequence: Synthetic primer
gatggtgttctggataaaaagcct

SEQ ID NO: 3671 - DNA, 23 bp, Artificial Sequence
  Description of Artificial Sequence: Synthetic primer
aaggtgagtatatgccgtgcttc

SEQ ID NO: 3672 - DNA, 21 bp, Artificial Sequence
  Description of Artificial Sequence: Synthetic primer
caagcaacaggggcagtcttc

SEQ ID NO: 3673 - DNA, 21 bp, Artificial Sequence
  Description of Artificial Sequence: Synthetic primer
ggctactggacagggctgaag

SEQ ID NO: 3674 - DNA, 20 bp, Artificial Sequence
  Description of Artificial Sequence: Synthetic primer
tgatgaacggagctgttgcc

SEQ ID NO: 3675 - DNA, 21 bp, Artificial Sequence
  Description of Artificial Sequence: Synthetic primer
cccctaccacaggccacatac

SEQ ID NO: 3676 - DNA, 22 bp, Artificial Sequence
  Description of Artificial Sequence: Synthetic primer
atgtactttgccagtgttgggg

SEQ ID NO: 3677 - DNA, 24 bp, Artificial Sequence
  Description of Artificial Sequence: Synthetic primer
gtcataattttcaccgtcttcagc

SEQ ID NO: 3678 - DNA, 20 bp, Artificial Sequence
  Description of Artificial Sequence: Synthetic primer
agcccttgccaagtcaataa

SEQ ID NO: 3679 - DNA, 21 bp, Artificial Sequence
  Description of Artificial Sequence: Synthetic primer
ttgtagtaccgctgcttccag

SEQ ID NO: 3680 - DNA, 22 bp, Artificial Sequence
  Description of Artificial Sequence: Synthetic primer
aagttctctctcagcacagtct

SEQ ID NO: 3681 - DNA, 20 bp, Artificial Sequence
  Description of Artificial Sequence: Synthetic primer
taccagacggtcatgctgcg

SEQ ID NO: 3682 - DNA, 20 bp, Artificial Sequence
  Description of Artificial Sequence: Synthetic primer
aaaagagagccagccgagca

SEQ ID NO: 3683 - DNA, 25 bp, Artificial Sequence
  Description of Artificial Sequence: Synthetic primer
tcatccttctttcttgagttacgct

SEQ ID NO: 3684 - DNA, 20 bp, Artificial Sequence
  Description of Artificial Sequence: Synthetic primer
ttatcggcgctgtgtcagca

SEQ ID NO: 3685 - DNA, 25 bp, Artificial Sequence
  Description of Artificial Sequence: Synthetic primer
ggatgatgaggatgatgacaacacg

SEQ ID NO: 3686 - DNA, 20 bp, Artificial Sequence
  Description of Artificial Sequence: Synthetic primer
tgctcgacacccacacaaat

SEQ ID NO: 3687 - DNA, 23 bp, Artificial Sequence
  Description of Artificial Sequence: Synthetic primer
acctgaaaacattggaccacaca

SEQ ID NO: 3688 - DNA, 21 bp, Artificial Sequence
  Description of Artificial Sequence: Synthetic primer
ggaagcaattgccaagaagca

SEQ ID NO: 3689 - DNA, 20 bp, Artificial Sequence
  Description of Artificial Sequence: Synthetic primer
ctcccagcatcccatacgct

SEQ ID NO: 3690 - DNA, 21 bp, Artificial Sequence
  Description of Artificial Sequence: Synthetic primer
ctggggatgaggggctctaac

SEQ ID NO: 3691 - DNA, 23 bp, Artificial Sequence
  Description of Artificial Sequence: Synthetic primer
tggcacgaaatatcaaggtctca

SEQ ID NO: 3692 - DNA, 20 bp, Artificial Sequence
  Description of Artificial Sequence: Synthetic primer
tgccacaggaaagggtccta

SEQ ID NO: 3693 - DNA, 24 bp, Artificial Sequence
  Description of Artificial Sequence: Synthetic primer
aggacttccctgaaaaagctaagg

SEQ ID NO: 3694 - DNA, 19 bp, Artificial Sequence
  Description of Artificial Sequence: Synthetic primer
agggggacacctatgaccg

SEQ ID NO: 3695 - DNA, 20 bp, Artificial Sequence
  Description of Artificial Sequence: Synthetic primer
gtccacagggttctccttcg

SEQ ID NO: 3696 - DNA, 24 bp, Artificial Sequence
  Description of Artificial Sequence: Synthetic primer
tcagttgacctatctccctcatgg

SEQ ID NO: 3697 - DNA, 22 bp, Artificial Sequence
  Description of Artificial Sequence: Synthetic primer
aacctcgaaactgcaaacagcc

SEQ ID NO: 3698 - DNA, 21 bp, Artificial Sequence
  Description of Artificial Sequence: Synthetic primer
ttcctgctgcggttcagtgag

SEQ ID NO: 3699 - DNA, 21 bp, Artificial Sequence
  Description of Artificial Sequence: Synthetic primer
gtgaaggagctggagaagcac

SEQ ID NO: 3700 - DNA, 24 bp, Artificial Sequence
  Description of Artificial Sequence: Synthetic primer
ccaggtgataaacttgtgatcgtg

SEQ ID NO: 3701 - DNA, 23 bp, Artificial Sequence
  Description of Artificial Sequence: Synthetic primer
gctggtgtttttaagatgggacg

SEQ ID NO: 3702 - DNA, 20 bp, Artificial Sequence
  Description of Artificial Sequence: Synthetic primer
tcaaacagggacccgtgctc

SEQ ID NO: 3703 - DNA, 20 bp, Artificial Sequence
  Description of Artificial Sequence: Synthetic primer
ccgcagaagtagtacgccac

SEQ ID NO: 3704 - DNA, 25 bp, Artificial Sequence
  Description of Artificial Sequence: Synthetic primer
catttactgtcctttcttctgggct

SEQ ID NO: 3705 - DNA, 24 bp, Artificial Sequence
  Description of Artificial Sequence: Synthetic primer
gggcattcccataataaagcatcc

SEQ ID NO: 3706 - DNA, 25 bp, Artificial Sequence
  Description of Artificial Sequence: Synthetic primer
gttctttcatcaaaaggcacattct

SEQ ID NO: 3707 - DNA, 20 bp, Artificial Sequence
  Description of Artificial Sequence: Synthetic primer
cctccattacgcaggaaggt

SEQ ID NO: 3708 - DNA, 20 bp, Artificial Sequence
  Description of Artificial Sequence: Synthetic primer
ggtgcttgctgttttgctgg

SEQ ID NO: 3709 - DNA, 23 bp, Artificial Sequence
  Description of Artificial Sequence: Synthetic primer
aggaacggatgttgtcatcttca

SEQ ID NO: 3710 - DNA, 22 bp, Artificial Sequence
  Description of Artificial Sequence: Synthetic primer
ttacagaacacctggtaggccg

SEQ ID NO: 3711 - DNA, 22 bp, Artificial Sequence
  Description of Artificial Sequence: Synthetic primer
aggtccagcccactcatcagca

SEQ ID NO: 3712 - DNA, 23 bp, Artificial Sequence
  Description of Artificial Sequence: Synthetic primer
tgtctgacattgcttcagagttc

SEQ ID NO: 3713 - DNA, 22 bp, Artificial Sequence
  Description of Artificial Sequence: Synthetic primer
tctcctctgtctcaccaaggtc

SEQ ID NO: 3714 - DNA, 25 bp, Artificial Sequence
  Description of Artificial Sequence: Synthetic primer
ggaaaacagtgttcagttaccaagg

SEQ ID NO: 3715 - DNA, 22 bp, Artificial Sequence
  Description of Artificial Sequence: Synthetic primer
ctgtcgctccttcttccttgac

SEQ ID NO: 3716 - DNA, 20 bp, Artificial Sequence
  Description of Artificial Sequence: Synthetic primer
aattgagccccacagaaggg

SEQ ID NO: 3717 - DNA, 24 bp, Artificial Sequence
  Description of Artificial Sequence: Synthetic primer
ttcacctccccattttagaaccaa

SEQ ID NO: 3718 - DNA, 21 bp, Artificial Sequence
  Description of Artificial Sequence: Synthetic primer
aatggtgttgggtgacctcgt

SEQ ID NO: 3719 - DNA, 22 bp, Artificial Sequence
  Description of Artificial Sequence: Synthetic primer
tgcgaatgatgtcagggaaagt

SEQ ID NO: 3720 - DNA, 20 bp, Artificial Sequence
  Description of Artificial Sequence: Synthetic primer
gaagggatgtggggcagctc

SEQ ID NO: 3721 - DNA, 21 bp, Artificial Sequence
  Description of Artificial Sequence: Synthetic primer
cggctccttgtccttcaacat

SEQ ID NO: 3722 - DNA, 21 bp, Artificial Sequence
  Description of Artificial Sequence: Synthetic primer
ctgaggactctgaggtgctgg

SEQ ID NO: 3723 - DNA, 21 bp, Artificial Sequence
  Description of Artificial Sequence: Synthetic primer
tgctgtaccttgcagtgttcc

SEQ ID NO: 3724 - DNA, 20 bp, Artificial Sequence
  Description of Artificial Sequence: Synthetic primer
ccatgaatcacccaggccat

SEQ ID NO: 3725 - DNA, 21 bp, Artificial Sequence
  Description of Artificial Sequence: Synthetic primer
gattcaccaccccaccctgat

SEQ ID NO: 3726 - DNA, 25 bp, Artificial Sequence
  Description of Artificial Sequence: Synthetic primer
atcaggtgtagttctgctgaatcct

SEQ ID NO: 3727 - DNA, 22 bp, Artificial Sequence
  Description of Artificial Sequence: Synthetic primer
ccaaatggttctgtgcctccta

SEQ ID NO: 3728 - DNA, 25 bp, Artificial Sequence
  Description of Artificial Sequence: Synthetic primer
agcgttaccatgatttggacattga

SEQ ID NO: 3729 - DNA, 21 bp, Artificial Sequence
  Description of Artificial Sequence: Synthetic primer
agaagtgctagaagccagtgc

SEQ ID NO: 3730 - DNA, 24 bp, Artificial Sequence
  Description of Artificial Sequence: Synthetic primer
ttttggatgttcctgacttggaca

SEQ ID NO: 3731 - DNA, 25 bp, Artificial Sequence
  Description of Artificial Sequence: Synthetic primer
gaaaacattcctgctctgaaagctc

SEQ ID NO: 3732 - DNA, 21 bp, Artificial Sequence
  Description of Artificial Sequence: Synthetic primer
aggatccggagacggaaatgt

SEQ ID NO: 3733 - DNA, 21 bp, Artificial Sequence
  Description of Artificial Sequence: Synthetic primer
ggcctgacagtggatgacgta

SEQ ID NO: 3734 - DNA, 22 bp, Artificial Sequence
  Description of Artificial Sequence: Synthetic primer
gcgagtacgagaagctcagtca

SEQ ID NO: 3735 - DNA, 25 bp, Artificial Sequence
  Description of Artificial Sequence: Synthetic primer
aaaagaaaatagaagccatgtttcg

SEQ ID NO: 3736 - DNA, 42 bp, Artificial Sequence
  Description of Artificial Sequence: Synthetic primer
tgttccaccaacgtttctcactgttccaccaacgtttctcac

SEQ ID NO: 3737 - DNA, 23 bp, Artificial Sequence
  Description of Artificial Sequence: Synthetic primer
ccatgagacaaggtagcatctgt

SEQ ID NO: 3738 - DNA, 20 bp, Artificial Sequence
  Description of Artificial Sequence: Synthetic primer
tgcctttctcctcctggaca

SEQ ID NO: 3739 - DNA, 25 bp, Artificial Sequence
  Description of Artificial Sequence: Synthetic primer
atgactaccacaaaggcactgataa

SEQ ID NO: 3740 - DNA, 25 bp, Artificial Sequence
  Description of Artificial Sequence: Synthetic primer
ttgcccagtaattctcccaatatga

SEQ ID NO: 3741 - DNA, 21 bp, Artificial Sequence
  Description of Artificial Sequence: Synthetic primer
actgtgtgactaccagggtga

SEQ ID NO: 3742 - DNA, 21 bp, Artificial Sequence
  Description of Artificial Sequence: Synthetic primer
tttcactcgctggagaccttg

SEQ ID NO: 3743 - DNA, 21 bp, Artificial Sequence
  Description of Artificial Sequence: Synthetic primer
cattgggcctgtcatgtggat

SEQ ID NO: 3744 - DNA, 21 bp, Artificial Sequence
  Description of Artificial Sequence: Synthetic primer
tggatctttccaccatgccag

SEQ ID NO: 3745 - DNA, 20 bp, Artificial Sequence
  Description of Artificial Sequence: Synthetic primer
attgccttgttcggcagcta

SEQ ID NO: 3746 - DNA, 22 bp, Artificial Sequence
  Description of Artificial Sequence: Synthetic primer
ctgcaagcacctgtttaactcg

SEQ ID NO: 3747 - DNA, 21 bp, Artificial Sequence
  Description of Artificial Sequence: Synthetic primer
aatgaaaaacacgcagcctgg

SEQ ID NO: 3748 - DNA, 21 bp, Artificial Sequence
  Description of Artificial Sequence: Synthetic primer
gtatgggaacgagatcgaccg

SEQ ID NO: 3749 - DNA, 24 bp, Artificial Sequence
  Description of Artificial Sequence: Synthetic primer
tctttcaagaaccaaactggtagt

SEQ ID NO: 3750 - DNA, 20 bp, Artificial Sequence
  Description of Artificial Sequence: Synthetic primer
gttaccagtgttcctgtggg

SEQ ID NO: 3751 - DNA, 20 bp, Artificial Sequence
  Description of Artificial Sequence: Synthetic primer
tcaccaaaacccaccccttc

SEQ ID NO: 3752 - DNA, 21 bp, Artificial Sequence
  Description of Artificial Sequence: Synthetic primer
gaagccatccgcagaagggga

SEQ ID NO: 3753 - DNA, 21 bp, Artificial Sequence
  Description of Artificial Sequence: Synthetic primer
catgtcagaagggttgggcat

SEQ ID NO: 3754 - DNA, 20 bp, Artificial Sequence
  Description of Artificial Sequence: Synthetic primer
cctcactgttcctcctgtcg

SEQ ID NO: 3755 - DNA, 22 bp, Artificial Sequence
  Description of Artificial Sequence: Synthetic primer
cggacacctactctccgtacat

SEQ ID NO: 3756 - DNA, 21 bp, Artificial Sequence
  Description of Artificial Sequence: Synthetic primer
ccatgtggaaagaaaccccga

SEQ ID NO: 3757 - DNA, 21 bp, Artificial Sequence
  Description of Artificial Sequence: Synthetic primer
aagtgaacaagggacgctgac

SEQ ID NO: 3758 - DNA, 20 bp, Artificial Sequence
  Description of Artificial Sequence: Synthetic primer
tgccaccaccgtcagacatt

SEQ ID NO: 3759 - DNA, 20 bp, Artificial Sequence
  Description of Artificial Sequence: Synthetic primer
ttgcttgctgtggggttgac

SEQ ID NO: 3760 - DNA, 20 bp, Artificial Sequence
  Description of Artificial Sequence: Synthetic primer
gaaggctgccaggtgtatgg

SEQ ID NO: 3761 - DNA, 22 bp, Artificial Sequence
  Description of Artificial Sequence: Synthetic primer
catggacacactcaagatccca

SEQ ID NO: 3762 - DNA, 23 bp, Artificial Sequence
  Description of Artificial Sequence: Synthetic primer
gggatttggaacaaaggttgcag

SEQ ID NO: 3763 - DNA, 25 bp, Artificial Sequence
  Description of Artificial Sequence: Synthetic primer
tgaagcattggatgatttaaaatcc

SEQ ID NO: 3764 - DNA, 21 bp, Artificial Sequence
  Description of Artificial Sequence: Synthetic primer
ttacaaggctgctcccgtcag

SEQ ID NO: 3765 - DNA, 22 bp, Artificial Sequence
  Description of Artificial Sequence: Synthetic primer
ccagtgaatactagagggatcg

SEQ ID NO: 3766 - DNA, 23 bp, Artificial Sequence
  Description of Artificial Sequence: Synthetic primer
attggctgagaaactccttcctg

SEQ ID NO: 3767 - DNA, 24 bp, Artificial Sequence
  Description of Artificial Sequence: Synthetic primer
cagtgttacaagttgtggaagccc

SEQ ID NO: 3768 - DNA, 24 bp, Artificial Sequence
  Description of Artificial Sequence: Synthetic primer
tctcctcatgagctttggtatcct

SEQ ID NO: 3769 - DNA, 20 bp, Artificial Sequence
  Description of Artificial Sequence: Synthetic primer
acccttccttcccagtggag

SEQ ID NO: 3770 - DNA, 20 bp, Artificial Sequence
  Description of Artificial Sequence: Synthetic primer
gccaaccgtatgagcttcgg

SEQ ID NO: 3771 - DNA, 20 bp, Artificial Sequence
  Description of Artificial Sequence: Synthetic primer
tcttccttcgctaacgcctc

SEQ ID NO: 3772 - DNA, 22 bp, Artificial Sequence
  Description of Artificial Sequence: Synthetic primer
gagagaaaggggaaaaaggggg

SEQ ID NO: 3773 - DNA, 20 bp, Artificial Sequence
  Description of Artificial Sequence: Synthetic primer
gagaacagcccgttggtgtg

SEQ ID NO: 3774 - DNA, 23 bp, Artificial Sequence
  Description of Artificial Sequence: Synthetic primer
agcaaggttcaaccagtcaagaa

SEQ ID NO: 3775 - DNA, 21 bp, Artificial Sequence
  Description of Artificial Sequence: Synthetic primer
cccacttctggactttgccta

SEQ ID NO: 3776 - DNA, 20 bp, Artificial Sequence
  Description of Artificial Sequence: Synthetic primer
ccctttccaacagccgagtg

SEQ ID NO: 3777 - DNA, 24 bp, Artificial Sequence
  Description of Artificial Sequence: Synthetic primer
attggagtaggctatactcagact

SEQ ID NO: 3778 - DNA, 20 bp, Artificial Sequence
  Description of Artificial Sequence: Synthetic primer
cgacggtggtggtgactgag

SEQ ID NO: 3779 - DNA, 25 bp, Artificial Sequence
  Description of Artificial Sequence: Synthetic primer
tgatgaagttgaacaggtcttcctt

SEQ ID NO: 3780 - DNA, 25 bp, Artificial Sequence
  Description of Artificial Sequence: Synthetic primer
ttggtcttgtggtcttgttatgggt

SEQ ID NO: 3781 - DNA, 21 bp, Artificial Sequence
  Description of Artificial Sequence: Synthetic primer
cttcgctgtatctgtcgcagt

SEQ ID NO: 3782 - DNA, 21 bp, Artificial Sequence
  Description of Artificial Sequence: Synthetic primer
tcggggagctcaaggatagta

SEQ ID NO: 3783 - DNA, 21 bp, Artificial Sequence
  Description of Artificial Sequence: Synthetic primer
tcaatttttgccagacgcagc

SEQ ID NO: 3784 - DNA, 22 bp, Artificial Sequence
  Description of Artificial Sequence: Synthetic primer
atgggcatcaaatccaaggctg

SEQ ID NO: 3785 - DNA, 20 bp, Artificial Sequence
  Description of Artificial Sequence: Synthetic primer
cgggactgggctcctctttt

SEQ ID NO: 3786 - DNA, 20 bp, Artificial Sequence
  Description of Artificial Sequence: Synthetic primer
taatggatgccaggggccgt

SEQ ID NO: 3787 - DNA, 22 bp, Artificial Sequence
  Description of Artificial Sequence: Synthetic primer
aacttgtgtgagaagaacccgc

SEQ ID NO: 3788 - DNA, 20 bp, Artificial Sequence
  Description of Artificial Sequence: Synthetic primer
cagggggttcacaatgcctg

SEQ ID NO: 3789 - DNA, 24 bp, Artificial Sequence
  Description of Artificial Sequence: Synthetic primer
ttctcaaaagcagacaccttctcc

SEQ ID NO: 3790 - DNA, 23 bp, Artificial Sequence
  Description of Artificial Sequence: Synthetic primer
gcttacttccataccaggaacca

SEQ ID NO: 3791 - DNA, 21 bp, Artificial Sequence
  Description of Artificial Sequence: Synthetic primer
tgagtccggatcaaacctttc

SEQ ID NO: 3792 - DNA, 21 bp, Artificial Sequence
  Description of Artificial Sequence: Synthetic primer
tgagcacctccaccttcatcc

SEQ ID NO: 3793 - DNA, 21 bp, Artificial Sequence
  Description of Artificial Sequence: Synthetic primer
gtaagacattgccttggttgc

SEQ ID NO: 3794 - DNA, 20 bp, Artificial Sequence
  Description of Artificial Sequence: Synthetic primer
agccccagtttcgccctact

SEQ ID NO: 3795 - DNA, 21 bp, Artificial Sequence
  Description of Artificial Sequence: Synthetic primer
ttctccaggagcaaggtgtga

SEQ ID NO: 3796 - DNA, 24 bp, Artificial Sequence
  Description of Artificial Sequence: Synthetic primer
acatgagagccatcttgtgatctg

SEQ ID NO: 3797 - DNA, 20 bp, Artificial Sequence
  Description of Artificial Sequence: Synthetic primer
ctgatagtgcttccgggtca

SEQ ID NO: 3798 - DNA, 20 bp, Artificial Sequence
  Description of Artificial Sequence: Synthetic primer
tcgtttacctgtgtctgccg

SEQ ID NO: 3799 - DNA, 25 bp, Artificial Sequence
  Description of Artificial Sequence: Synthetic primer
tgtgaagatgagttcagatccaaag

SEQ ID NO: 3800 - DNA, 20 bp, Artificial Sequence
  Description of Artificial Sequence: Synthetic primer
gggtctggaaggtgaaccca

SEQ ID NO: 3801 - DNA, 20 bp, Artificial Sequence
  Description of Artificial Sequence: Synthetic primer
ttggaccgcatgtcgaggat

SEQ ID NO: 3802 - DNA, 20 bp, Artificial Sequence
  Description of Artificial Sequence: Synthetic primer
tgttctcggcagagccaagc

SEQ ID NO: 3803 - DNA, 21 bp, Artificial Sequence
  Description of Artificial Sequence: Synthetic primer
aaatgccagcactttcagtcg

SEQ ID NO: 3804 - DNA, 20 bp, Artificial Sequence
  Description of Artificial Sequence: Synthetic primer
ctcagccgtccagaaatgct

SEQ ID NO: 3805 - DNA, 22 bp, Artificial Sequence
  Description of Artificial Sequence: Synthetic primer
agcccaaccttgtggcctccag

SEQ ID NO: 3806 - DNA, 18 bp, Artificial Sequence
  Description of Artificial Sequence: Synthetic primer
ccggtgtgggatgtgcag

SEQ ID NO: 3807 - protein, 4 aa, Homo sapiens
DEAD

SEQ ID NO: 3808 - DNA, 52 bp, Homo sapiens
gactctggaaggaaaaactatatttctttacattcagcctaaaattgcatga

SEQ ID NO: 3809 - DNA, 60 bp, Homo sapiens
gagacttactgtatgggtggacattatagagaaggaagaagttcaagaagagcttagaga

SEQ ID NO: 3810 - DNA, 65 bp, Homo sapiens
cctctggtaaccaccattctgctgtctacctccacgagatccacttttttagcttccacacatga

SEQ ID NO: 3811 - DNA, 91 bp, Homo sapiens
tgaatatggccacaagcaggctaataggggccgtggccggcaccattctggccctgggggtgatttttggaggcacagggtggggaataga

SEQ ID NO: 3812 - DNA, 47 bp, Homo sapiens
cctgttttctgaagcggacgaagtgcaaatcatatccaaagcataga

SEQ ID NO: 3813 - DNA, 120 bp, Homo sapiens
ttcataaataaagtggatggacagaatttcaaggatcgcatcatttctgacttcatatcatcgattttatagccagaaagagctttctaatctttcagcatattcatgaattaaatgaga

SEQ ID NO: 3814 - DNA, 75 bp, Homo sapiens
tttcacccaccagtatgtaagctgcatgagggcagagtgagtttctccagcatctagcctagggactggcacaga

SEQ ID NO: 3815 - DNA, 63 bp, Homo sapiens
gatactgcagccatcagcagacaatcaatgcaatcatctcagactgtgtcctgcgtcccagga

SEQ ID NO: 3816 - DNA, 139 bp, Homo sapiens
ggcattaatctattcataaagatatacgtccatgacccaaccacctcccactaggggatcaaatttcaacatgaggtctggagggtttggtgtccaaactacaggactcctttaagagagtgaaaggataaatcacaga

SEQ ID NO: 3817 - DNA, 88 bp, Homo sapiens
gtgaaaacagctccagcgtgagttttggcaccacactggtagaaaacacttggtgttcagacccttttggacctgggggaattgcaga

SEQ ID NO: 3818 - DNA, 152 bp, Homo sapiens
gtggccacttcttgactgctttgagtccctcatccgagcgaagggcggacggagtccgttggtgggggtccggttgcctctcccgggagctgtgtagacttctcatacaccagggttctggaggcagatggaggagccctttcgaaaacaga

SEQ ID NO: 3819 - DNA, 61 bp, Homo sapiens
ggaaaccaagaataccaactcactttgccttgtctgtgatgagaactgaaaaacctacaga

SEQ ID NO: 3820 - DNA, 121 bp, Homo sapiens
agtatctcctgcatgccagcaagctatggacatctggaagaagccacatgccttgccctcaagttgcttagggtggaaggaaatgattagaaatgagccaagccgagcctgcactcttaga

SEQ ID NO: 3821 - DNA, 102 bp, Homo sapiens
caagctatggacatctggaagaagccacatgccttgccctcaagttgcttagggtggaaggaaatgattagaaatgagccaagccgagcctgcactcttaga

SEQ ID NO: 3822 - DNA, 141 bp, Homo sapiens
ctctgaaattaaatccctactgactggcccttgaactgattttttctaacatcagcaaaagtcaaggagtgtttccctaaaaaagaaagcatttactcagaaaccgtatattgaagtccaggctgaaaaatgcaaacatga

SEQ ID NO: 3823 - DNA, 113 bp, Homo sapiens
taaaatgaagttaatggaaccatggaatctaccttggagagttgctagaagaattaaatgaagtcacatatgtttagtgcccagcacagcgtccagcacataggtggtacaga

SEQ ID NO: 3824 - DNA, 49 bp, Homo sapiens
ggccgtcaacctttccaccttgaaactggtgtcaggagcaccctgcaga

SEQ ID NO: 3825 - DNA, 108 bp, Homo sapiens
ttctagaggctggtaagttcagggtcaaggaggcctcatcaggtgagggcctttttgcaaagtcattccatgaccgaaggtggaagggcaagagagcacactcagaga

SEQ ID NO: 3826 - DNA, 59 bp, Homo sapiens
ggaaaaaaaatgctcctttcattccaagtttgactccagattttgctgaatggattaga

SEQ ID NO: 3827 - DNA, 126 bp, Homo sapiens
gggccttccagagaacaaatggctggtccttttccaaggggacagattttcctacctgatgcttttgttctccagcaagaaaagaaaatgaaaactgttgtcttcccctagaatattgagtccaga

SEQ ID NO: 3828 - DNA, 66 bp, Homo sapiens
gaagcttgaaagaaatttcacattttctgcaaggacttaaacctgagctctcagctttctgcaaga

SEQ ID NO: 3829 - DNA, 72 bp, Homo sapiens
gtaattagctgagaaggaagatctgaaggtttaacgagagagggcgagagatacaaaatatctgctaggaga

SEQ ID NO: 3830 - DNA, 9 bp, Homo sapiens
tctaggaga

SEQ ID NO: 3831 - DNA, 179 bp, Homo sapiens
agcaaaccccattgtcaggggaaagcagaacaaagaaaagtatttagaaatgtatttccgggatgcacagattcttttcaccctcaccttcccctaggttgttgcagctgcgcacctgctctgtgaagcacagattgtcatgggggcagttctctcaaaaacatggcatattgtgatga

SEQ ID NO: 3832 - DNA, 90 bp, Homo sapiens
gttgtatgctttctctgtgcagggataaagtctattcattctgttttgtcttttacaagatctattgcaatgcattgcaggctcggcaga

SEQ ID NO: 3833 - DNA, 39 bp, Homo sapiens
gatcccattgatggatggaaactctagtttttacttaga

SEQ ID NO: 3834 - DNA, 88 bp, Homo sapiens
gatgttttcatctggcccaagaagaacttgttcttaatgttaaaagacctttttgctaaactgggaagaaagtgctggaataacaaga

SEQ ID NO: 3835 - DNA, 91 bp, Homo sapiens
agctctcaaaagtacaggaaagagattgcttcagtgtggtgagaagtttggcacacatctgaccaatggctccatctctagcaaatccaga

SEQ ID NO: 3836 - DNA, 73 bp, Homo sapiens
gagtgccccagatctccctgtttcacctgtgattatctgtgatgccatagcaacaccccttgctgttagcaga

SEQ ID NO: 3837 - DNA, 67 bp, Homo sapiens
atgaaagaactgagctttggaggctaaattacttgtcccaagttaatacagcttagaaagtgataga

SEQ ID NO: 3838 - DNA, 75 bp, Homo sapiens
gcaatctacacagctatttcctgtggggaaatctccttgaagagtctgccagattcctcttggaaccctctcaga

SEQ ID NO: 3839 - DNA, 90 bp, Homo sapiens
gccttgttcaaagctctgggcatctagcaatgagtaagatagtcaagatctgtgctctgtccacgttctcttggagcttacattttaaga

SEQ ID NO: 3840 - DNA, 164 bp, Homo sapiens
gtaattattgaacatctacttgctgcctactttcaacatctgcatgtgtgtgtgaatattaaatatcacaccaagacattgttcagaggagacagaatagtgagctgagataaatgagaatctctctatggaagattagactggagcatgaacttgaaatatga

SEQ ID NO: 3841 - DNA, 135 bp, Homo sapiens
tgagcaccataaaataaaaacgccatacaatccaacaattatttattagttcttgccattcgcaacatcctgcctaatacatggaatacaagacagtattccttccacttcaagaagactgttttctagccaaga

SEQ ID NO: 3842 - DNA, 85 bp, Homo sapiens
ctatagaaatgcaaatcaaaggagcataagccaatagagggaatgaatatactgacttccatccacagaccagagggaaaacaga

SEQ ID NO: 3843 - DNA, 404 bp, Homo sapiens
gtccaagcggctgccctggggcttgacattgaaggcggcgcccacgggagaccagctggtgctgacccttcgggcccggatcccggcttcgaggcttccccggcccgcccggcggggcggcagagctgctgctctggctcccaagccgcccagccttccgacgcacagcattctagcaccagagcagtcccttcctccaacgcagatccctgccctgctgctttcgctgggagcgcgcgctccgcgtttccaaggcagcagcccacgccgccccacgtgacggccccgcttccgggtctgggcgcggcctcaggacgtgggcacgttgtcgtccagagagcaagagcgtcgctccccctcgccttctcggccgccctcccggtttaccgccccctgtgtccaga

SEQ ID NO: 3844 - DNA, 102 bp, Homo sapiens
tgccaacatccccagtgaaactttaagaggagccagtgtattccaggttaagttggggaatcagaatgtggaaactaaacaacttcttagtgcaagctatga

SEQ ID NO: 3845 - DNA, 60 bp, Homo sapiens
taggaaacaccccaatcctgagtcccccaagcacatgcagtggttccccctccatgaaga

SEQ ID NO: 3846 - DNA, 143 bp, Homo sapiens
gaacggacagagtttaagatggtgaaggccaataaaaaaaggaaaaaaatgatgcagactctcaagaaaatgctgttttcagtctccatgtggaatttcaggatgtattagtacagcccgagctggaagggttgaagcagaga

SEQ ID NO: 3847 - DNA, 143 bp, Homo sapiens
attaaaaaaatcagccgatgtggtggtgcatgcctgtagtcccaggtaattgggaggctgaggcaggaggattgtttgagcccaggagttcaagtctgcagtgagctatgatcatgccacagtactccagtctgcgtgacaga

SEQ ID NO: 3848 - DNA, 1507 bp, Homo sapiens
ggtagcctctgagggtaagtgactaagacttctcctctgctgtccaagcgctttggtgcagggacagcggcatcttcagccaatccagtgcaggctctccaccgaaggctggctctagactggtggtacgcacatagcatagccatggccgactcctgctgtggttctctgacgattgtgcttcttgttaatcctctgtcgtgctttggtaatcgtattgattagagttggtaactgtcttgacttgaattttgtccctttaaaactgctgtacctgtatgataaagatgcagtacctttctcttaaaaaaaaatgctatggaaagctgtgagaattgaagagacaaattggctgtgtcagtgtggggttatgtcatgatttctagaagccctgaagttgctcttttgagcagctttgcatgacacgctctggtaaaaggtgtgcatctttaaattatttcatggatactttgaaaaatattgtatcacttcaaatacagcaataagtttatatgttctcaagatttcatttgtttttaagaattttaagttcgtggattaatatcactacttgaatactgacagttgttgattagacaccgaaaggttactgattgttgaatgtatctgtgttagagctgtgcactggcacgcttgcatcaggggctggggccacacggccgccacacagattcccccgtgatgcctggagctgcttccagagccgggtgtctccaagaggcacctgtaggacttcccatttagaaatctcttgagtgggtttgtatgttaccttctccaaggtttatttaggacagagatattgctggaaggtcatgggtcagattccctcacaacccacctcgtctgcgggtgcagccccactccaaggctccccgttattggggtatgtgaggagcagtaaatataaaaccagttcaactgtcctcatggaatcaccctttctgtttttgcagtattcataaagctagtgtaaggtctggttttagtctattaaatcttagagatctaaaggaaatgctcaaaatgtagccaggttttaaatgctttaacttttaaaaaatgtaaatttttgtatgtttatagcttctaaatatgaaagttaaagaatgtactgtgatgaaatgttcagtattatgttgcttctcagtatcatgttgcttctcagtattgtgttgcttctgattctatgaatgttcattttaagaccccttgttgaaatgggacagttggcagcggctctgatgagcccgagaagaggcctgcccttgggtgcggagtctccctccgcacgatgctcccacgcgtccaacttgcacccaaggggcttttccctcttccaagtggactccttcaaggaagctgcagctcggtcagcagagaaggggcctgccgccagcgccctggaggaagaggaagaggaacccaagaggatggcttgtctcccagcagccacaccggctttgtgctcagccagttcatttga

SEQ ID NO: 3849 - DNA, 53 bp, Homo sapiens
tcaggaagtctgaagtctaaaggatatgagcagaagttaaccatgacaataga

SEQ ID NO: 3850 - DNA, 34 bp, Homo sapiens
gtttttggggaacaggtgctatttggttacatga

SEQ ID NO: 3851 - DNA, 64 bp, Homo sapiens
ataaattgaaaaaatgggaggaaagagaaatggaacacctcaaggtgatactgaagtttagaga

SEQ ID NO: 3852 - DNA, 115 bp, Homo sapiens
gtgacagcctcttctttttataagctcctttatcagacgtaacctcctcaaaagcaaagactgtcatacagattttgtaatcccctgcagtggctagccaagtagcctgtggaga

SEQ ID NO: 3853 - DNA, 65 bp, Homo sapiens
gagagttctttgctcaaagatctgaagctcttggttgccttggtggtggtaacaatgtgaaaaga

SEQ ID NO: 3854 - DNA, 139 bp, Homo sapiens
accagaggctgggctctggattacagctcagtagtgggtcatggaatatgtactgtgactcaacccgtatcattttcaagaaagaagagagagaaaatcgttcagcaaatataactgaatgaattatctggttcacaga

SEQ ID NO: 3855 - DNA, 130 bp, Homo sapiens
gttgaggccttggctcctgcctgtagtcccagctacttaggaggctgagagaggaggatcgcgtgaacctggaagtttgaggctgtagtgagctatgattgcaccagtgcactccagcttggatgacaga

SEQ ID NO: 3856 - DNA, 195 bp, Homo sapiens
ccagtctcagcagaagagtaacatgacatgagagattgggaaactgtccttctgtggggttcttcagacaacctaagccatctcctacatcctacactcgctgaacatagaatggttgaaggaaagaatgaatacatatgtagaagagaagaatcttgctaaaaggaatgaagttgtcaagataaataattaaga

SEQ ID NO: 3857 - DNA, 83 bp, Homo sapiens
aatgaacactccatgagagcagggacctgctttgccttgttcaccactttattcccagtggctagaaccacgtctgacacaga

SEQ ID NO: 3858 - DNA, 72 bp, Homo sapiens
gtttttaaaactcatttggacacccacctcaatatatgctgtgcaattagaataatccagaagactgaaaga

SEQ ID NO: 3859 - DNA, 104 bp, Homo sapiens
ttcttcaagaaacttggttttagcattggaatactgtgagcatcatttcatgtatcctttgggagacaggaatttatgattttcccccctttcttggttataga

SEQ ID NO: 3860 - DNA, 136 bp, Homo sapiens
ttaaccgggtgtggtgataccacacctgtagtgccagcaacttgggaggctgaggcaggaggatcacttggatccaggaggttgaggctgcagtgagctatgatcacaccactgcactccagcctcggtgacaaga

SEQ ID NO: 3861 - DNA, 99 bp, Homo sapiens
ggtctttgtcacccaggctggagtgcagtggagctatcacagcccactacagccttgccctccctgggatcaagtgatcctcccaactcagtcgccaga

SEQ ID NO: 3862 - DNA, 252 bp, Homo sapiens
tagagacggggtttcaccttgttagccaggatggtctcgatctcctgacctcatgatccacccgcctcggcctcccaaagtgctgggattacaggcgtgagccaccgcgcccggcccacgtttgtgatttaaacaacaacaacaacaacaacaaccagttaacgtaattgacagcagagaagttccaggcagaacagtggctctttcgtttttcttctacacatggctttttgccatcagcatcagtgaaga

SEQ ID NO: 3863 - DNA, 259 bp, Homo sapiens
attgggtcttatccccaagatatctcattatgtacatgcaaatcagcggagcatcgtcatgacaccaggaggacaccccgtgacgccgattaccgcactctcaacctcaacccagcgtcagagttttctggcatctcttctttgagcctggccgcctgcagctggaaatgctcatatatggtggtgtgactaacctgagagagagagatcagggatcctgagaagttctgcattcttggtctgcttcccagtgggacga

SEQ ID NO: 3864 - DNA, 61 bp, Homo sapiens
ggcctttctgtctggtgtgtgcagaatgatctgggtcacctctgaggcccatatttataga

SEQ ID NO: 3865 - DNA, 116 bp, Homo sapiens
cagagaaatctcaggaggcaccatgccaggccactgtgcccctgcaagtgtgtctgagtatggcccaggaccctgcccatcactggtctgcaacaagataagcacagaagttcaga

SEQ ID NO: 3866 - DNA, 141 bp, Homo sapiens
agtcatgacaccctgttcaaactctctggacttcagccagttgtttggctagatacaattctcagagaggcaaaggaacattacaaaggtaatggcatgaataccattacctgtatgcatgcaacaggaaccctgcacaga

SEQ ID NO: 3867 - DNA, 178 bp, Homo sapiens
ttttgccaaggagtttgtccacagagctcttcatgccctcatgctggaagtggaaatctggacatgttatcttatcatgtcattatcacacctaggaaaatgagcaacaattcttcaggatcatttaatgtcaagtttataacttcctgctttaacttaaaaaaaaaattaaattaga

SEQ ID NO: 3868 - DNA, 62 bp, Homo sapiens
gtggatcatattggatacctgtggtcattaacaaactactatgttatgaaattacaaaatga

SEQ ID NO: 3869 - DNA, 56 bp, Homo sapiens
gccgaagatggtgttagtgattgcgagctgctggctggcacccttgcagagcagga

SEQ ID NO: 3870 - DNA, 158 bp, Homo sapiens
gtgcagtttgaacagggcttgacagtggctggaccatcactaagtgagactttaattcatcaagcataactgaaaatggaggcagtagattatatcttggtagccagcatgtgtagacttgtcttatttggagcccacttggaattttcatttcaaga

SEQ ID NO: 3871 - DNA, 59 bp, Homo sapiens
ctgtggcataagaatgaaaagaaaagaaacaaaagcagatggcagagaaaacgaaagga

SEQ ID NO: 3872 - DNA, 27 bp, Homo sapiens
gtcaaagtcgtactcttttgtttgaga

SEQ ID NO: 3873 - DNA, 131 bp, Homo sapiens
gccaaaatcatattatatgatcaacctcaagtgcatgggaagctgtgaaagtgaacattgaactgggtataatgttaccctgaacagtatgaaggtctatgagcaagaaagaaggggtgaatgaattatga

SEQ ID NO: 3874 - DNA, 46 bp, Homo sapiens
ataggacagcatttaaaaatctcatgtggaagaatataccactaga

SEQ ID NO: 3875 - DNA, 84 bp, Homo sapiens
gagtgatgaatctaagcaggaatgccatccaccttcagagccattggcgtgaggatgacggtgtgaagtcttttcaaagcagga

SEQ ID NO: 3876 - DNA, 59 bp, Homo sapiens
tacataatttaggatgagaagcacgagttaccgaatgaagatctggttgatcccccaga

SEQ ID NO: 3877 - DNA, 51 bp, Homo sapiens
ataaaattctggaacagacaattatgtccttacaaacaacaacatttgaga

SEQ ID NO: 3878 - DNA, 112 bp, Homo sapiens
ccatgaatcacccaggccatcttaaactatttgtgacaaggatcatgcaagactttgaaagtgacacgttttttccagaaattgatttggagaaatataaacttctgccaga

SEQ ID NO: 3879 - DNA, 71 bp, Homo sapiens
gcatgtactaacataacatcataacagcctctttaatggaatggagggaattctctaacgggagacctaga

SEQ ID NO: 3880 - DNA, 48 bp, Homo sapiens
ggttttgttcctaatgtcacatgtttcctaagtaattcagcataaaga

SEQ ID NO: 3881 - DNA, 122 bp, Homo sapiens
gtaaattagacccaaaataactcccagggagcaatacacagcctggaaaacatgaaacaaggagcggctgtttggtgtaataaaggaggagcaccaggctgaattttcagaggcctaataga

SEQ ID NO: 3882 - DNA, 61 bp, Homo sapiens
gatggaatgtcatcccaggagccatctcttttcctcggagggcatctcaagaccccccaga

SEQ ID NO: 3883 - DNA, 105 bp, Homo sapiens
gataggcagtactttgtgaaccagctacaacagaatcagctgcagtgcttgttaaaagtctggattctcaagttcactccaaacttattcaatcagtttgtgaga

SEQ ID NO: 3884 - DNA, 813 bp, Homo sapiens
ggacacggacatctgcaacctgacatcagcttgtactcatattctgggttttcggtgacaagtgacacacagttgatcataagtaccaatcatagactgaaaatgctctgcattttagagacagaagttaaaagcttttccatcctgtttacagaaagtttgctttttatctctaaagaggctcatgacccacctgaataggtgaattgaaggatgaggcattgcaaggaaaggctgctaaccctcccgttcctcctttcacttcttgccattttcttacaaaactttggttgttccgcatgggtcttgagaggtggggccgttatagtagctgatagcagtgtcacttgggccacgtttgaaaccacaccaatcacccatgtagcatttaagacctgtggaaacgacgctggaatcaaaatacctgtctgtgttagttgttccaagctggagaaagctacttcaggacggttggctgaatggcaacagtgatggaatatttatatttagccacatgtgctgaatgtggctgtcacaagtttaaaatgctttcctgtaagaccatttgtctgttactcacttgcgttctttctcatctatatttagatggcttactgtagcttttaaaggcactggcgttttacatggtgctggtgattcatccacctgctccctacattcattgtggtccgcttctgacagtctcctttaaggagagcttgtaggcttctaatttcacatttcagcaagctggctaaagacatgtgggaaagcctgaccctggattcaggtcaaatctcagcactcacaaga

SEQ ID NO: 3885 - DNA, 82 bp, Homo sapiens
cattggccaggactactagaactgtgtcaaaacagctgctacactaacgggcatctttgtcttgttctcagtcttaaaaaga

SEQ ID NO: 3886 - DNA, 71 bp, Homo sapiens
gttcagggatgctggaaaggacactgaagtaggccttggctgatgggcctttcagaagtgaacacttaaga

SEQ ID NO: 3887 - DNA, 140 bp, Homo sapiens
cagctgctcttccagcccggtctcatcccacagtgggctcctccccagtccctcactctgccatggaccctaacacaatatgtgtgtggagcggactcccccaagggtggtactggagtggcctcgcatagcacatcaga

SEQ ID NO: 3888 - DNA, 97 bp, Homo sapiens
gtatgctcctgaagtgagaagcagtggttcaaggaaaggcacctggggagtgcatggcagaggacatcttgagggatggggaccaccggcatcaaga

SEQ ID NO: 3889 - DNA, 151 bp, Homo sapiens
agtctgactgttgcccaggctggagtgcaatggcaccaacatggctcactgcaaccttgacctcctgggctcaagtgatcctcccggcctccgtctcccgaatagcggtcttactcattttctacgtgtgtgttgagtgcaccatttgaga

SEQ ID NO: 3890 - DNA, 155 bp, Homo sapiens
acagagtctgactgttgcccaggctggagtgcaatggcaccaacatggctcactgcaaccttgacctcctgggctcaagtgatcctcccggcctccgtctcccgaatagcggtcttactcattttctacgtgtgtgttgagtgcaccatttgaga

SEQ ID NO: 3891 - DNA, 88 bp, Homo sapiens
ctgcctaattgaaatattcagagagcagaagttacttactctcgtctcacctcctacttctctcagaaaatgtagtacgacttctaga

SEQ ID NO: 3892 - DNA, 106 bp, Homo sapiens
gtgtttgaaatggcagaaaatgaaacggggtaaggatgaactcctgtatagatagactggataaagagaaagccaagtgcatgatgttcatagaggagtcttaaga

SEQ ID NO: 3893 - DNA, 63 bp, Homo sapiens
acagacccttccagaaccagatgaccatcaagacaaaagcatactcaagcagacaagaaagga

SEQ ID NO: 3894 - DNA, 144 bp, Homo sapiens
gctgaagcagattcaatatggacttgttaaaacgtatgttttgtaaattgagtttatctaaatcccagtctagaagaaggaagctcattttctctagaaagtgaatttcaaagtaaaaccacatgttggatgaaatacaataga

SEQ ID NO: 3895 - DNA, 108 bp, Homo sapiens
ttccatacaactatcccgctgattctttcttcaaagaagcaaaccctcctttgctttttatattttcttcacacatggaaatgggggatgtggagggccttgcacaga

SEQ ID NO: 3896 - DNA, 172 bp, Homo sapiens
gggccacctccatggctgcagccgcgtcacctccgtcccatcatctcgctggttaaacgtggaaaaacggggtcttgagctctccacggtctcccctctggttgggccggaacaaagatttataaaagcagtgttgaaaaatctttctgcaattggattgagaaaagacaga

SEQ ID NO: 3897 - DNA, 12 bp, Homo sapiens
gatatctagaga

SEQ ID NO: 3898 - DNA, 160 bp, Homo sapiens
gttggttcatgtgatcctggttaatggaacataagtgagattttatgggtgacagggagagagatcaggcttgacttgagagcacgtgggaaaagaagggggctatctcttcgcaaagatttaagtatcttataagaactgtttgccagtgcaattatga

SEQ ID NO: 3899 - DNA, 58 bp, Homo sapiens
actgctgtggaattcctgagaaagagcaactgagggatagcaacatggatttcactga

SEQ ID NO: 3900 - DNA, 94 bp, Homo sapiens
ggtgtggagcgagacctgcgaggccaggtgccgggtggcgagcggggcctggtggaggagtatgtggagaaggtccctaaccccagcctgaaga

SEQ ID NO: 3901 - DNA, 134 bp, Homo sapiens
catttatgacattaacagagaacaggactatgtcaagaattctgagggtatacttggtgaaaatgaattaagaccaccctcccagctacattctctcttagagaagatcgagacagggtccctatcagaaaaga

SEQ ID NO: 3902 - DNA, 55 bp, Homo sapiens
atcacatgagggccacctgagagaagtgagaccacatgagggaaaacccaaaaga

SEQ ID NO: 3903 - DNA, 261 bp, Homo sapiens
gcacagtggctcacacctgtaatcccagcactttgggaggccaaggcaggtagatcacctgaggtccggagttcaagaccagcctagtcaacatggtgaaaccccgtctctactaaaaatacaaaaattagctggtcgtggtggtgcatgcctgtagtcccagttactcgggaggctgacgcaggagaatcacttgaacccgggaggcagaggttgcagtgagccgagatcgcgccactgcactccagcctgggctacaga

SEQ ID NO: 3904 - DNA, 81 bp, Homo sapiens
gattaattaccgttaatgtcttggagactataacgtacactgcacgttgtaataacacaaaaggacaagcaagatgtaaga

SEQ ID NO: 3905 - DNA, 147 bp, Homo sapiens
aaattagccaggcctggtggtgggcacctgtagtcccagctacttgggaggacactgaggcaggagaatcgcttgaacccgggaggcggggggtacagtgagctgagatcatgccactgcactccagcctgggacctgggcaacaga

SEQ ID NO: 3906 - DNA, 80 bp, Homo sapiens
aaaaagacagtctacagccataccacccggaatgtgctcaatctcatctaatctcagaaaaagacaaatttccacgaaga

SEQ ID NO: 3907 - DNA, 92 bp, Homo sapiens
gacaaaaagcaaagaagaagactgtggtctagaagccgaaggaagatgagaaggaagagtgtccgaggagtcagccacagccagaaaggaga

SEQ ID NO: 3908 - DNA, 34 bp, Homo sapiens
gtttttggagaataggtggtatttggttacatga

SEQ ID NO: 3909 - DNA, 121 bp, Homo sapiens
ggatatgattacatttccatcgtcagtgatggactgaatcctgcttctatgcagctaagaaatggaagagttacaaacgggttcttttcatggaaggaaagaacagcaaatgagaagcaga

SEQ ID NO: 3910 - DNA, 58 bp, Homo sapiens
ggcagaggtggagaggggttagattatttcatctgccctacagttggcataataaaga

SEQ ID NO: 3911 - DNA, 56 bp, Homo sapiens
aagaggcagataaagagctagagaaagacattgaaagttgaaggcaagaccagaga

SEQ ID NO: 3912 - DNA, 47 bp, Homo sapiens
aggtgcctgatgctgttaattcctgagccttttgaagattctgcaga

SEQ ID NO: 3913 - DNA, 129 bp, Homo sapiens
ccacattttttttttcttaaatatcacctgggagtgtgttggaaatggacaatctcagcgctcatcccagacctactgaatcagaatcagcactttaacacagtccctaagtgatgtaacacctggaga

SEQ ID NO: 3914 - DNA, 64 bp, Homo sapiens
ggattgtttgtattcctgccaatgatttgtgagacagtctgttccccacatcctcgtcaacaga

SEQ ID NO: 3915 - DNA, 103 bp, Homo sapiens
gtctgggatgagaccagagtcctcttccctatgaagctgccacaggctgggctctggggggacacagacgtgcctgagggtggccctgtatcacccgtggaga

SEQ ID NO: 3916 - DNA, 83 bp, Homo sapiens
gagctctgatttgaggtgacaatgattttgaaccttaaattctttggaaagactcagaatgaagtccattgtggaggctcaga

SEQ ID NO: 3917 - DNA, 147 bp, Homo sapiens
aatttccagtctagtgacgtgataatgccatggactaatcatccagtgctgaatgtcggagcacagggtcagggaaagcttgaagaaggagaaggtttcagtggaagtggacgcatggaggcagagagatgttcaggaagcagcaga

SEQ ID NO: 3918 - DNA, 70 bp, Homo sapiens
caagaaagtgctcggctcgcgatcaggcgcttgtttatttgaacgtggacattcccaggatccgaaaaga

SEQ ID NO: 3919 - DNA, 78 bp, Homo sapiens
ctttctgacatcttaacgaggcaatacagagagacgaattttcatcagtttgttcagggagacacatataacaaaaga

SEQ ID NO: 3920 - DNA, 115 bp, Homo sapiens
aggcaagccctggtgctgtgggagccccaaggaagagcctctggcctggtggccacgtagcccaggagagatttctacaggagcccacagcgctgaaggagagagaggcagcaga

SEQ ID NO: 3921 - DNA, 51 bp, Homo sapiens
atccatacatacttaatgctgaaatgtgaagggctgagaaaaaagaaaaga

SEQ ID NO: 3922 - DNA, 137 bp, Homo sapiens
tggctgagtaatcttcagatcccagtacttagcaagtgctcagtcggtgttggatgtaggccacaaaccggatcgtaaagaattcaactgtatattgacagccacggaactaatcaatgaatagatccgtatgaaga

SEQ ID NO: 3923 - DNA, 65 bp, Homo sapiens
gattttcctttttctcttgaaatcgtataccctcttcaaagagagaaagaaatgcttccaataga

SEQ ID NO: 3924 - DNA, 102 bp, Homo sapiens
gttgaggctgcacctgggaaaaaacacaaattagaggagcatctgtgacccctgccttttccaaagagggttttgaggactccgatatgtaaaagagaaaga

SEQ ID NO: 3925 - DNA, 98 bp, Homo sapiens
aaatcccatccatagtgtggaactgaagtagagaaggcaaaagatggattcaatcagttgtttgaaacaggtcccccaaaggcacacatcttcgcaga

SEQ ID NO: 3926 - DNA, 178 bp, Homo sapiens
ggtcttcctctgttgcccaggctggagtacagtggtgtgatcatagctcactgcagacttgacctcctggttggggagtggtggtgtgcaccagtggtcccagctactcaggaggctgaagcagaaggacccccccagcccgggaggcgctccagaacaccccagcttgggtgacaga

SEQ ID NO: 3927 - DNA, 153 bp, Homo sapiens
gccatccagtctcctggctttactgggtggagaggtgctcagcagcttctgtcactagctctgaatggcctgtctcctggacaaagaagctttcacggactactctgcagggaggtgacattggaccagagctgactccacctgggggaaaga

SEQ ID NO: 3928 - DNA, 108 bp, Homo sapiens
gatattttcattgtctccgaattttagagctgaaaagtgccttagagatcatctagttcaacctctccgttcaaatggagaacctgagccactaagattcacaggaga

SEQ ID NO: 3929 - DNA, 177 bp, Homo sapiens
gaatgagtaaataggttaaagatataacttcaggaatttagaatggcaagaagtcttcagtgccgggccttgcagatagagaaataaaacaccgtatctgctgttgaggtgttaacctggattttcacctaagaaccactgctccaatgtgttttgaaaatggaatactcctctaga

SEQ ID NO: 3930 - DNA, 181 bp, Homo sapiens
gtcaggaattatggttaaaggtggattttcactgatggtaataagatattactttataccccttccctcctcatgaattaagtccatctaatctttactgaggacctgctgagtggtagacactatgatttgtttctgtttccacagatgtcacaattgtcagtaattgtggacctttaga

SEQ ID NO: 3931 - DNA, 219 bp, Homo sapiens
ttctcaggttttcttgacaccaagaaagagagggaatcaagaagatcggttgtaagagagcaattcaacatgaaaatactgaagaagagatgggagagagagagagataattgttttcttcagagttttccactttctatcagtaactctgatcacatggatatctattgtggggctagttgatgcatcccttcagatgtgttggaaagaggaccaaga

SEQ ID NO: 3932 - DNA, 136 bp, Homo sapiens
aaacacttacctatgtgaacatctgaaatgtaactgtgacccagagcgtaaacagaaaacttccctgagtctttggaattataattttgaaaactgtgatgtaaaattgatgtattctcaggactgtggatttaga

SEQ ID NO: 3933 - DNA, 126 bp, Homo sapiens
gcacgagtattcgatgtaatttcggctgttttgatacttatcaagaaggaaagctctgatagttgctcatggaaaattgcaacatcatcacactgtgtgaaaaattaatgaagcattcatcctaga

SEQ ID NO: 3934 - DNA, 329 bp, Homo sapiens
cattttcccatggaaagcagggtgcttctgtagctggcctgggccccgtgggccccgagaggcagatgtggatgctcctggagccacttctgtaaaaggctcctcgatgcggatcatgtaaaagccagaacgaagggcaaggcccttaggggcggggcttgagcgcaagaaccgaatatccagcagctgtgacgtgtggagcctgcaggccgggagagcagagcccacaacagcactcttgttttgtcttcacaccacgtccctaagctccgggaaatccaggaggaggcctctttagtcttgaggaagtagggagtcttttacccaga

SEQ ID NO: 3935 - DNA, 193 bp, Homo sapiens
gagcggggcggcgggcagcgatctgggcccggggcagtcgcctttgattatcgagggcgctggcgttcggggaaggttggcagcaccttacgagacccacacacgtccccggggcggcacgggccaccttctgcggagcctcgtgggcttcgccgccgtcgcacctccgccgcctgcgctctgcggccccaga

SEQ ID NO: 3936 - DNA, 138 bp, Homo sapiens
aagtgggaacagaggcctatggtagtagtttacttgtccaaagactcagagctagtgactgatgaagttgggactcaaatcctacattctacctcttaaaccaggaaacttccctctacaccccactgcttctgaaga

SEQ ID NO: 3937 - DNA, 155 bp, Homo sapiens
gctaccttctcctgccacagatactctatcccatttgctgtcatccaacgactaacaccgttttcacttcagaacgtcaagccttttctgttctcttcatggcctcctcccattaaagctgaaagtatctgctatcagtcatttgtcctaactga

SEQ ID NO: 3938 - DNA, 60 bp, Homo sapiens
aatgttagaacgactttccaagtttgaagttggagatgctgaaaatgttgcttcatatga

SEQ ID NO: 3939 - DNA, 104 bp, Homo sapiens
gcacagctagatgcggtggctcatgcctgtaatcccagcacttcgggaagtcgagactacaatgagccatgatcacaccgctgctctccgtcctgggcaataga

SEQ ID NO: 3940 - DNA, 69 bp, Homo sapiens
gttctaatgggagaagtgagagcagaaaagggaagcacaggaacctactgaggaatccacttgcaaaga

SEQ ID NO: 3941 - DNA, 120 bp, Homo sapiens
gttgatgtcatatttttagtcttgagaaacagcatcatgccaaggaaagagcttgagctttggagtaatgcggccctgagattgaattctggctctgccacttattagctctgttctaga

SEQ ID NO: 3942 - DNA, 82 bp, Homo sapiens
gtgaagtagtatttgaagcttttcatcagttggctcattctttactcaagaataaacctcaagaaacgtcatcagggtcaga

SEQ ID NO: 3943 - DNA, 175 bp, Homo sapiens
gtttccttccttcgctgccgcagcgtgacttttgaaacctggaactctaggggagccctaaaacgagcgtgttgtccgtgaggataagtgccttcagagaagtctgaatgggctgttctcccaacagtgtgtttctctgtattccatccccattcatgggctgaagttgctcaga

SEQ ID NO: 3944 - DNA, 57 bp, Homo sapiens
aatacctatccaaatgttttccttctgaagtattatgttctacttttagaaaacaga

SEQ ID NO: 3945 - DNA, 75 bp, Homo sapiens
accttaattctatgagagtaggggctgtgactcatttatctgactaaatcatggcctaacgatgcctcagacaga

SEQ ID NO: 3946 - DNA, 97 bp, Homo sapiens
aattggaaacatcgagggaaaatgggctttttattattaaaacaaaacctcagtattatcacttagaaacctgaaattgaactccaaaagccaaaga

SEQ ID NO: 3947 - DNA, 138 bp, Homo sapiens
taaatgaaaaagaaagtctggctatttggagtaaattaatgagctcctagaggagatgggactagcagagtctgcttgtaccaggaactcttagcgtcgatttcgagctgttgctgccaaagtagcaaggaccaaaga

SEQ ID NO: 3948 - DNA, 199 bp, Homo sapiens
atatgatagcagccttggtgagcagaccacgaccatggggtttacccagtgggatcccgtcacggcttcttccctgcctgtgtctctccccgacccctgattccggccatgaagtcttaagagccaagtgctgtgtgcggctgcccagcacaaaccgtctcactcttttcattgtccataggcttttgcttttttaaga

SEQ ID NO: 3949 - DNA, 24 bp, Homo sapiens
ggtcaaacaactgttctgccgaga

SEQ ID NO: 3950 - DNA, 53 bp, Homo sapiens
aaagcgtgctctggaatggattcacaaatgagctaccctccttccctcaaaga

SEQ ID NO: 3951 - DNA, 44 bp, Homo sapiens
ggcacttcctcacatgccagcgcaactccccaatacctcaatga

SEQ ID NO: 3952 - DNA, 44 bp, Homo sapiens
gaaccctccctcaagcatggtgttagactgggtgacaatggaga

SEQ ID NO: 3953 - DNA, 135 bp, Homo sapiens
cattaatttacagaaatacacgtattctccttgttttggtggaagctgcagctgccaatcatctctcaaaccctgtgggtagctgctaagctgtatttcagaggaatgtcacaatcataccactggggagaaaga

SEQ ID NO: 3954 - DNA, 33 bp, Homo sapiens
aggctgaacactttagaactactaccagaaaga

SEQ ID NO: 3955 - DNA, 53 bp, Homo sapiens
tcattcttcactacctcgcctgagtcgtacctcctccatggaacagtctcaga

SEQ ID NO: 3956 - DNA, 75 bp, Homo sapiens
gtctgggtggtggctcatacccgtaatccagcacttttggaggccgaagtgggaggattgtttctgggcagcaga

SEQ ID NO: 3957 - DNA, 122 bp, Homo sapiens
atgggacctgcaaaggataaactggtcattggacggatctttcatattgtggagaatgatctgtacatagattttggtggaaagtttcattgtgtatgtagaagaccagaagtggatggaga

SEQ ID NO: 3958 - DNA, 49 bp, Homo sapiens
aggcgtgtgtgtatgtgtgtgtgtgtttcttttcctgaacagattgaga

SEQ ID NO: 3959 - DNA, 56 bp, Homo sapiens
ataggacctcttctgacatccccaggaatattatatgattagaagccaagggatga

SEQ ID NO: 3960 - DNA, 156 bp, Homo sapiens
gtgaccaactgagtgccatattgaattccattcagtcacgacccaatctcccagctccttccatctttgatcaagctgcaaaacctccctcttccctagtacacagcccatttgtgttcggacagcccctttccttccagcagcctcagcttcaga

SEQ ID NO: 3961 - DNA, 89 bp, Homo sapiens
gcatctagcatagaactccctattctgcattatgactactggaccacttatctctctgccctacttgataagttccatgaggacaaaga

SEQ ID NO: 3962 - DNA, 60 bp, Homo sapiens
cttgctgctacttgccaggccttaagtggaagaatggagtgttgattgtgtcagtcaaga

SEQ ID NO: 3963 - DNA, 137 bp, Homo sapiens
gatcccatttgaacagaaaactcacattttctctggtggaatcactgatgtacaattgagaactgatggtttgtgttggctgcatcatcaagatctcttctgagaaaacttggtgtgaaatgaagattataaagaga

SEQ ID NO: 3964 - DNA, 66 bp, Homo sapiens
atttactttatcacatacctatctgtctatccatcagtctgtcttagtttcttcatgcatttcaga

SEQ ID NO: 3965 - DNA, 119 bp, Homo sapiens
gtggaagtggaatactggaagaacccagcagatcaactctgagctgccctttgccctttcagaaagtatctcattccaaacagttcttcgaaactaacctcttgccctccagctacaga

SEQ ID NO: 3966 - DNA, 87 bp, Homo sapiens
gttggtagaggtgcagcaatttttgcagtgaaactgaagtccagctgctcaaacagaaatggcctcatctaatggacactttaatga

SEQ ID NO: 3967 - DNA, 92 bp, Homo sapiens
gtattaaaggaagtaatccggtccatacctgagcctggtatgccctcctcccggacgttcctgttttctgatcgtcttcagcacagacatga

SEQ ID NO: 3968 - DNA, 55 bp, Homo sapiens
tgactgctcatgaaagaaattaaaatgatacatcatcagtggatcttcctgtaga

SEQ ID NO: 3969 - DNA, 143 bp, Homo sapiens
ctcactgcttagaatctaaggagacaagaccataataaaggacagtgtagaagacctgaagttttaagctccaaatctcttagctaccaaaataaataaatactacagagctgtttgtgagcaagagaaaacatctagacaga

SEQ ID NO: 3970 - DNA, 74 bp, Homo sapiens
tgttccagggcgccattaacgattggagttggcacaaaatttgaaactagaagtggactatttgctccttgaga

SEQ ID NO: 3971 - DNA, 84 bp, Homo sapiens
gggctcaggagtccagcggtcctaagtataccttgcagccatcttcctaaaagttctgaccatgactgaggacactgagaagga

SEQ ID NO: 3972 - DNA, 54 bp, Homo sapiens
atgaaaactactccaatcaacttcttcaatctgttctgccacattttagccaga

SEQ ID NO: 3973 - DNA, 209 bp, Homo sapiens
tgatgacaaataaatggttccagcctaaactgacagccagataccattgtccagctttttgtctcatggaagccgcacgcttcaaatatgcaccaggtgcatttctgttgctggattgggctctgagcaatctgatgtcccctgaagaagtggattgtgaaggccatggatggagcagggaatagaaatggatactctattgtgccaga

SEQ ID NO: 3974 - DNA, 63 bp, Homo sapiens
agctctacctctgttttgaaatgtcattagtttggatatgttaccaggatgcagcaaagaaga

SEQ ID NO: 3975 - DNA, 161 bp, Homo sapiens
tgttttgaaatgcttcagagaatgtgcgatatccttatcaacatgataaaatatgaaactgtgattgcctgcagcattttacagacatgaattccatcttcactgatgaggcttgataaggcgctgttgtataatacagtgcataatctcaaaccaccaga

SEQ ID NO: 3976 - DNA, 152 bp, Homo sapiens
tgaacaagttaccagatccttctcctctgaactcgggttgcaaaaaaagccttcagttcggctctggacagcatttacagacgctcttgaagccgagcgcccacacagtgtgaatttgaatgaagctgcgttggcacaaacccctgttaaga

SEQ ID NO: 3977 - DNA, 97 bp, Homo sapiens
ctacatcatcttttctaattaagagaaagagagaaaaccagcgtgcaacttaaagacagctaaggttatcttctgaaagatgcgggttcttactaga

SEQ ID NO: 3978 - DNA, 104 bp, Homo sapiens
catgaaggaatggccacaggacaggtgactagtcattgtgggatggaattatagtcgatgaagtgagccttggaggaagtcatggtcctactcagagaaacaga

SEQ ID NO: 3979 - DNA, 63 bp, Homo sapiens
tcttcaaggaaaactatttgattttcacatctatgatgagagaaaacagaaaaattgtcaaga

SEQ ID NO: 3980 - DNA, 110 bp, Homo sapiens
attatcaaatacagaagtagaagccaagattgaatgtgttcctgtgattgaaactttgatgtcactgataaaatatccccagataaggccttctaagagatctaagcaga

SEQ ID NO: 3981 - DNA, 84 bp, Homo sapiens
gggcatactgcaactgtcagtgcatactttacggtgggaaaacttggagaaggaatgggttaggaaaaaatcagtttctgagga

SEQ ID NO: 3982 - DNA, 47 bp, Homo sapiens
tgagcttggagtgaagtctagtacgtctgtgcagcaaagagaccaga

SEQ ID NO: 3983 - DNA, 202 bp, Homo sapiens
gcgaaaatgggcagtgtttacaggcatgaatgctggtggaaagagcagagtaagggcagattgcacaagaaccgtggaggccctggttcccatcacctccacctcagcacagacttcagagaggagaggaggcactggatgcatgacagcagcacttgagataggtgctccaggtggaaggcactgcacatgcaaaggctga

SEQ ID NO: 3984 - DNA, 92 bp, Homo sapiens
ggattcccccagcagacgtttttcatctaagaaatggcttgagtgcttccttttatcgggtgctgtgatagattctcaaaatatgaaaatga

SEQ ID NO: 3985 - DNA, 62 bp, Homo sapiens
attttgcatttgttggatttgttagtagtgaagatactatggtgaagatgaaggaagaaaga

SEQ ID NO: 3986 - DNA, 39 bp, Homo sapiens
atgtccacttaaaaaaatctggcgatgggagcagaaaga

SEQ ID NO: 3987 - DNA, 57 bp, Homo sapiens
atggtgactgatgcatctctaacacaccacatcacagacttcctgatcatcagaaga

SEQ ID NO: 3988 - DNA, 130 bp, Homo sapiens
ccctgtaatctcttcaagagatgatgatctttgatggcattttgggggtgatgttcaggtggcagccagattggaggggaccgtggagcagactgtgtgactactcattccaagggcatcattgtggaga

SEQ ID NO: 3989 - DNA, 69 bp, Homo sapiens
gaccgaactcagaggccacctcatcctattaaacctgttctggttcctgacatcccccgacccacacga

SEQ ID NO: 3990 - DNA, 70 bp, Homo sapiens
cagagagacgcaacatccacaagcttcttgatgaagtctttttttctgaaaaaatttataaactcaatga

SEQ ID NO: 3991 - DNA, 96 bp, Homo sapiens
ctgtaaagtttgactgagaaatgttgcatcagccctgaagtttattgagaaaatcttacgctgatgcaaactttttggactgttagtgtcttatga

SEQ ID NO: 3992 - DNA, 128 bp, Homo sapiens
agtgctggaatatgaatgagccaaattgtgctgttccattgacactggttgctacagaattaactttactcggagatccgaggagccatcggcagttcccaggagtaagaacctgagagcgtgtgaga

SEQ ID NO: 3993 - DNA, 104 bp, Homo sapiens
agtgctggaatatgaatgagccaaattgtgctgttccattgacactggttgctacagaattaactttactcggagatccgaggagccatcggcagttcccagga

SEQ ID NO: 3994 - DNA, 60 bp, Homo sapiens
aataacaacctgagtgcttctcccagggcgtggtccagacgattttgtttgaggggaaga

SEQ ID NO: 3995 - DNA, 93 bp, Homo sapiens
agtgaaaacgccagtgaggaagctggtgagggtgaatatgtcaatctgtattcctctggccagagcagcgaggagctggctccctctcgagga

SEQ ID NO: 3996 - DNA, 224 bp, Homo sapiens
ccgagcgtggtgacgcatgcctgtaatcccagctactcgggaggccgagacatgagaataatttgaacccaggaggcagaggctgcagtgagccaagatcgcgccactgaactccagcctgggggacagagcgagacttcgtctcgaaaaaacaaacaaacaaacaaacaaaaaactgtcctccagaaaaagaaaaaggaattggagacctaggagccggaaga

SEQ ID NO: 3997 - DNA, 98 bp, Homo sapiens
gaccatcttaagcaagtctcttctcctgtgctacttgacgactcttttgatacatgaagacagctatcatggccctcctgagtcttgttttctctaga

SEQ ID NO: 3998 - DNA, 162 bp, Homo sapiens
gttaactactgtgagatagtggggccccaatgaaacatataagcataccttttaaaatgttgccaaatagtcttcagagaacatacttaatacaaaaatgctgtgcagacatcattccgattgatcgactgatggatgactccgcagtttggattagagaga

SEQ ID NO: 3999 - DNA, 88 bp, Homo sapiens
ctgaaaaggagatgaagatcctgcttgtagctgagcagtctttagaagtctgctgcattcttcccaaattccatcactctagtcaaga

SEQ ID NO: 4000 - DNA, 119 bp, Homo sapiens
ggtgaggagcaatctgtgggaagtcagtgcacagtagagttcagtcttccaacgctgaaaatttgccaactttcacccacactgtggagatgagaaagcagctgtgggcagacagtaga

SEQ ID NO: 4001 - DNA, 91 bp, Homo sapiens
aatggtttattattgccagttttggcctcctcagtgccctcacactctgctacatgatcatcagagccacagctagcttgaatgctaatga

SEQ ID NO: 4002 - DNA, 89 bp, Homo sapiens
gaagactttgccagtctctggtccacactgttactggacttcaggatagcacattgttcaccacagaaggaaagatgtggaaattaaga

SEQ ID NO: 4003 - DNA, 80 bp, Homo sapiens
aacgtgtccctagtgctaagtggcgcgggactctgctttgcctgctgtcctgcggaggcaggaggtgaccaggagagtga

SEQ ID NO: 4004 - DNA, 57 bp, Homo sapiens
ggtacaggatacagtttgactacttaaagtttgaagaaaaaagaagagtaagaaaga

SEQ ID NO: 4005 - DNA, 100 bp, Homo sapiens
gtcctcatagcacacgattgctctcagataatgtcatttgtaaaaaggaagcatgtacagtagaaacggtccaatcctggtgctggatgctttcatagga

SEQ ID NO: 4006 - DNA, 81 bp, Homo sapiens
aactccaggttgaccatggcagaaagggctcagattccccttccagtgcttcttgccaaaatctgggaaataggaaccaga

SEQ ID NO: 4007 - DNA, 60 bp, Homo sapiens
agaaaggatttgaacttggccttcatgtatcaactaagttaatcgagccttgaattgaga

SEQ ID NO: 4008 - DNA, 45 bp, Homo sapiens
gcattctgttcaggcagcaatttggaaatccaccatttatcatga

SEQ ID NO: 4009 - DNA, 54 bp, Homo sapiens
atttaacatttttgagtcaatccaagtaatgcaggaggttcatgattgtgtaga

SEQ ID NO: 4010 - DNA, 177 bp, Homo sapiens
tagaaacagggtttcgtcgtgttggcgaggctggtcttgagctcctgacctcaggtgatccacccaccttggcctcccaaagtgctgagattacaagcatgagacactgtgccaggccaagagctttggagttttctaaggaatccagtgaataccaagttccatgcttatgaaaga

SEQ ID NO: 4011 - DNA, 108 bp, Homo sapiens
gctcttctggaaccctggactcaagtgatcctcctgcctcagcctcctgagtagctggaactataggcacaagccacagcaccgccttcagtctttgctttgagtaga

SEQ ID NO: 4012 - DNA, 163 bp, Homo sapiens
gcctttgagccctacttagagattttggaagtatactccacaaaagccaagaattatgtaaatggacattgcaccaagtatgagccctggcagctaattgcatggagtgtcgtgtggaccctgctgatagtctggggatatgagtttgtcttccagccagaga

SEQ ID NO: 4013 - DNA, 35 bp, Homo sapiens
gtggattcctagaagtggcattgctcagtcataga

SEQ ID NO: 4014 - DNA, 102 bp, Homo sapiens
ggacaactgcattattggcaagcgctaagcaacatggagaagcagacatgtttgtgaatcgcaaagtgaaatctgattctctccaactatggatgagtgaga

SEQ ID NO: 4015 - DNA, 57 bp, Homo sapiens
tcagcattttgtagttttcagcatatacgtcctgtatgtattttgttagatttacga

SEQ ID NO: 4016 - DNA, 117 bp, Homo sapiens
ccaggcttggtggtcccagctacttgagaagctgagttaagaggattgcctgagcctaggaggttgaggcttcagcgagctgtgatcatgccactctactccagcctgaatgacaga

SEQ ID NO: 4017 - DNA, 53 bp, Homo sapiens
atttgttcaagttgaaattgtaaacctatgccagaacttgcatgaagagatga

SEQ ID NO: 4018 - DNA, 114 bp, Homo sapiens
ctgggaagactgaggcacagtcatacagctaaatagtgacagaatgaggattgaatccaaacattttacagacgggaggactgagtcatagtcatacaactaaataataacaga

SEQ ID NO: 4019 - DNA, 36 bp, Homo sapiens
tattggaatatgacagggaagatgaattcactatga

SEQ ID NO: 4020 - DNA, 95 bp, Homo sapiens
aagaatgttccttttgtgaagaatgacttaaggaagattcatgatgactgagtgtgcccgtgtggaactttaggacatagatgcactcctacaga

SEQ ID NO: 4021 - DNA, 144 bp, Homo sapiens
agtttgcaaaggaaggaaaggagcagagacttgaatgagcagaaaatcatttcagggcctgttctctatgtccttgctatccctgtcttctgtagctattctgaaaccatcaacaaaggagcacaccattccatcagcaaaaga

SEQ ID NO: 4022 - DNA, 146 bp, Homo sapiens
aatccacaaaaattagccgggtgtggtggcacacacctgtaatgccagctactcgggaggctgaggcaggagaatcgcttgaacccgggagtcagaggttgcagtgagctgagatggcaccaccacactccagcctgggcgacaga

SEQ ID NO: 4023 - DNA, 113 bp, Homo sapiens
ttcagcagtgcagagagaagccgtgaggagttccggtgtgaagagaaagaatctgaaaatggaatgctcttcctccctcccctaagtggaaaatgtgaggggaactttttaga

SEQ ID NO: 4024 - DNA, 58 bp, Homo sapiens
atatcgcagcacattgcaaagtctctgacacctttccctttccagtgtcattaaatga

SEQ ID NO: 4025 - DNA, 114 bp, Homo sapiens
gtattcagtagaagcagatgaacagccagatgaagagatggatagagcaagacatggacattataaaggaattcaatagaagcacatgaacggccagatgaagagatggataga

SEQ ID NO: 4026 - DNA, 129 bp, Homo sapiens
gtgtggttgtacgtgcctgtagtcccagctacttgagaggctgagctgagaggatctcttgagccggggaggtcaagtctcctgtgagcagtgatcatcgtgccgctgcactccagccttggcaccaga

SEQ ID NO: 4027 - DNA, 70 bp, Homo sapiens
ggtggctgcactcaacgagtttatgcaatgactttcttggatgtttctgaaggaggaggatgtacagaga

SEQ ID NO: 4028 - DNA, 150 bp, Homo sapiens
gaggcggatcttggtcagtaatgcttgctcgctgcttgctgctcacctcctgctgtgcagccaggttcctaacaggccacagaactctactagtcctcagccctggaggttggggactctcctctaactggctgttcgttatgcctgaga

SEQ ID NO: 4029 - DNA, 203 bp, Homo sapiens
aactaggcttggaagaagccaagagaagctgcatgacaaggaccaggactgtggaataggagcagcctagtgaatgtactgcccgccaccagacgctggccccctgctgatagctctgacgactgctgctgctttgtccttcactccgtactccagttggccaagcataggtcgcatgccagggtcaaggagactaagggaga

SEQ ID NO: 4030 - DNA, 26 bp, Homo sapiens
gtttaaccatggttggaaatgacaga

SEQ ID NO: 4031 - DNA, 87 bp, Homo sapiens
aatgtaagctccatgagggaaagtactttgttgctcttcttctcctcagtatcctcagcgttaggacaatgcagtgatattgaatga

SEQ ID NO: 4032 - DNA, 99 bp, Homo sapiens
gtggtccctgagttaagaacatgcaatggcactctctcaaggagaggaaggagccaaagaagaaagaggtccaaagcagaaaagagcagacagctaaga

SEQ ID NO: 4033 - DNA, 99 bp, Homo sapiens
ttgaagacgataattctaacttcctgtcagttgaagacgataattctaacttcctgtcagttgaagacgataattctaacttcacacttaattaaaaga

SEQ ID NO: 4034 - DNA, 156 bp, Homo sapiens
gaagatgatcaccttgccaaggaagcatcatgtaatatatcagctcatcagcagggagtgaagaggaagtctgatacaccactggggtccccactagaacctggtcaaatactggagaagaatgaggatagcagtaaagtcaaactcaaaatcaga

SEQ ID NO: 4035 - DNA, 83 bp, Homo sapiens
ttttgagatccaccaaatatgtcattgttgccagtcttctttcccaagatgtatggatagtttttaatgtctcataaatatga

SEQ ID NO: 4036 - DNA, 232 bp, Homo sapiens
ccgatttcagcctaccaatgtgaggccactgagttggaaagagatatgatcttcggtctttgcgatgctggctgggtctgctgctacgccgctgcctgtcttagttcacagaggaaatagtggctgtcaggctggaatgctctcaatttccagttgccagatgtatggacttacgctatatgctcaaccacacctgaattcatcctccctgtcttccctttgttacaagaga

SEQ ID NO: 4037 - DNA, 140 bp, Homo sapiens
ctttggaccttcctctccctctggtttcctgacttctataaaagaatagttgaactaactagtggcatacctgttcagcatcatgactggtttccgaaacatgttcctccataatgttgagagccgtggtagcgaaatga

SEQ ID NO: 4038 - DNA, 33 bp, Homo sapiens
atcccgctatctgtcctgtgatgccatactaga

SEQ ID NO: 4039 - DNA, 98 bp, Homo sapiens
attccagaatgaagaagatgcctgtagccaacctgtagctgacaacaaaaatgagaaatacattttgcgctgtctgttgaacccaagaccctttcaga

SEQ ID NO: 4040 - DNA, 79 bp, Homo sapiens
gatttgcctccaagaaaaaatatattttattgccacattttctcaattgatccagtagagttcacagacaatgaaaaga

SEQ ID NO: 4041 - DNA, 60 bp, Homo sapiens
ttgaagagataccatttgacattttagagatggctgcatgcaaactcttaaaacatttga

SEQ ID NO: 4042 - DNA, 96 bp, Homo sapiens
agatcatgcgtaatattcctgtttcatgggccataaggacatgtgtttaattcataaggacatatggattccatttgaaacaggatctcacacaga

SEQ ID NO: 4043 - DNA, 285 bp, Homo sapiens
ataccagagaagcgtgaacatattgctttgaaatctacttgctcctagtaaaaaagagattgtctttattggaaaattccctctgagattcctgtgatgtgtgacctggtggggaatattccagcctgggaacagcttaacatctggtgtctgtatgagttacccctgaactcactggaacattcaatggagggtttccctttgtgttgccacaaattttatttcagtgaagatgtgctggtgagagtttcagcaacgttttagcctgaacagtggaattataga

SEQ ID NO: 4044 - DNA, 76 bp, Homo sapiens
gagtaagatcttctgtctctgaagcttcttaggggcaagcttttttactgaaggccaagcatttaggcactataga

SEQ ID NO: 4045 - DNA, 87 bp, Homo sapiens
ggattggtgtctctatcatccagctggccattaaacaaccaaagcttcatcatcctagataacctgtgagctctcagaggagacaga

SEQ ID NO: 4046 - DNA, 39 bp, Homo sapiens
ccatcctagatctgagatttgcaacctggaagttcaaga

SEQ ID NO: 4047 - DNA, 105 bp, Homo sapiens
ggaaggtaatgagaattatagtactttaattttccaagctcttgaccatgaatgtgtagattatttttcagaaggcgtagatacaatgcagttatcaaatgcaga

SEQ ID NO: 4048 - DNA, 161 bp, Homo sapiens
gatgggagagagaagagcatgaaagaagcggttgggattagccttcttcagtaacataccctggggtcgtcctttggaatttcatggttattgtggtgtatgtgaccacatttagagtgcactgcctcagacctgccttaaagctgtgtcataggataaga

SEQ ID NO: 4049 - DNA, 76 bp, Homo sapiens
caccaatacattattatgaagtcagtacagagagattggcatcttagtattttctgaggaagagaacagccaaaga

SEQ ID NO: 4050 - DNA, 64 bp, Homo sapiens
gccccaggtcccctggcaccggtcccaagcacagtttgtccactgaggaggaaactctggcaga

SEQ ID NO: 4051 - DNA, 34 bp, Homo sapiens
gtctatagaagaggagggaaaaacacacctagga

SEQ ID NO: 4052 - DNA, 154 bp, Homo sapiens
ttgtggcgcgcgcctgaggttccagctactcgggaggctgaggcgggaggattgcttgagcctggggagttgagaccagcctgggcaacatagcgaaaccccgcctcagaaaaagagagggagagaggaaagcagtggagttattggtcaaaga

SEQ ID NO: 4053 - DNA, 46 bp, Homo sapiens
gtgctgtataaacagatgagagtgcccccacagcattgttattaga

SEQ ID NO: 4054 - DNA, 58 bp, Homo sapiens
aatgaccacctgagaaggagtgtgctgtaacctctgagaagcactgtgctgtgataga

SEQ ID NO: 4055 - DNA, 280 bp, Homo sapiens
gatcacaacttttacagatttttaaaatattggccgggcgcagtggcccacacctgtaatcccagcactttgggaggctgaggcaggagatcaagaccatcctggctaacacgatgaaatcccgtctctactgaaaatacacaaaattagccaggcgtggtgacacacacctgtagtcccagctacttgggaggctgaggcaggaggatcacctaaacccgggaggtggagattgcagtaagccgagatcgcgccactgcactccagcctgggcgacaga

SEQ ID NO: 4056 - DNA, 36 bp, Homo sapiens
gtcactggacctatttgggctggggagaacaacaga

SEQ ID NO: 4057 - DNA, 80 bp, Homo sapiens
gctttggggcagtggtcatttccgggaccaggccttttcattgccagctgactacccagcactttgagctcatgaataga

SEQ ID NO: 4058 - DNA, 265 bp, Homo sapiens
gaacaaagcctgagcctccaagccagaagcaaagtttgtatgcgtggttagacaggttgtttctgattggagagaacctggaaagaattaagccagtcacacacaggtccatctctgaagcccagccatcagatcagtcatctgctggtcctggagaggagtgagtggaggacacagagaaactgcagatgctcctttcatgaccttttctcctgagaaatggagtggggcatttgtctcctgtgtgggaacatgggaatgcaga

SEQ ID NO: 4059 - DNA, 32 bp, Homo sapiens
acatggcagcccctagcatgtgtatcctaaga

SEQ ID NO: 4060 - DNA, 48 bp, Homo sapiens
agctgcccctggagcagaatattccctgcttggtccaaaccacagaga

SEQ ID NO: 4061 - DNA, 63 bp, Homo sapiens
cctcctggcaaggagcagagctggcgggaggcggctttggggaagaatctctgtccacaaaga

SEQ ID NO: 4062 - DNA, 74 bp, Homo sapiens
gctttctgcgggagcagtggtggccccggcttctcacccttcaggttttcttgcatctgcgcaccggtggaaga

SEQ ID NO: 4063 - DNA, 36 bp, Homo sapiens
gttgtccaacatgtgagcattttctggctggggaga

SEQ ID NO: 4064 - DNA, 54 bp, Homo sapiens
ccatcaacaactcttagctgaaagagggataaggcccaagcaaggatagagaga

SEQ ID NO: 4065 - DNA, 119 bp, Homo sapiens
atctttgtacattatccctgtgttgaaatgcaaataggacttccctggaaccaaatcttctatatcccagaacttcttgtatcaacaaagtaagatggttgatacagtgcccaaataga

SEQ ID NO: 4066 - DNA, 120 bp, Homo sapiens
gggcacagggtcaaggataccagacctggagactggaagtcttttcagagagactgtcctcagagaggagaccagaggcatgagttcgggtcggcaggaaatccccctgtgcagtgaaga

SEQ ID NO: 4067 - DNA, 62 bp, Homo sapiens
gcctctggaagagcaggacctctcccagactgtgattgggaggagtttgggatggttacaga

SEQ ID NO: 4068 - DNA, 62 bp, Homo sapiens
gcttctggaagacaaagacctctcacagactgtggctgggaggagtttgggatggttacaga

SEQ ID NO: 4069 - DNA, 64 bp, Homo sapiens
gaggatgtatttaagcttttgtctcatgtgttccatgatgaattaactgacttgagtaactaga

SEQ ID NO: 4070 - DNA, 100 bp, Homo sapiens
aaatcaagaagttttaatatttgagcagtgcttatggaggttttaaagagaatatattcctcaaaattctaattacttctgtgattttactgcctccaga

SEQ ID NO: 4071 - DNA, 139 bp, Homo sapiens
agtcttgctctgtgcccaggctggagcgcaatggtgtgaacttggctcaccgcaacctccacctcctggattcaagcgattcttgtgcctatccccaacaccagcaccatacctggcacacggtgatcattcagtaaga

SEQ ID NO: 4072 - DNA, 63 bp, Homo sapiens
agtcaagaacagacactgagtcgcttgaggactcaggcaggtgtttgctgcattgacaacaga

SEQ ID NO: 4073 - DNA, 98 bp, Homo sapiens
ctactcaggaggctgaagcaggagagttgcttgaacctgggaggtggaggttgcagtgagccaagattgcaccagtgcactccagcctgggcaacaga

SEQ ID NO: 4074 - DNA, 45 bp, Homo sapiens
aaactgcaagtcccctgatttccaaccctttccctctcctacaga

SEQ ID NO: 4075 - DNA, 188 bp, Homo sapiens
gcagaactggccgtgaactgtggctcagggagctggaactgagtcatcgaactgcttcagaaaccacagtaaaggacaaggtctgcaggcctgcctgcgtggctataaatggctgtcttcctccaggcctctggaagggcacggtctctcccagactgtggctgggaggagtttgggatgattagaga

SEQ ID NO: 4076 - DNA, 62 bp, Homo sapiens
gcctctgaaaaggcaggacctcttccagactttggctgggaagagttttggatggtttcaga

SEQ ID NO: 4077 - DNA, 289 bp, Homo sapiens
gcctcactacttcctcattccccatgtcggaaaccccagggtggaacccagaccacctgagcacacctgctgcaatggactgctgcccactcctaggagtggttgaattgcctgccttcacctgcctcgatgtctcgctctgcttatagcagaagccaggccagaatacccagaagcccgttcagcctctacagcaggggccgggcacatagaagatgtttccaagtcaaacatacatataccatactgactcattgatatgagtctgcaatgcaactgttatcaaaga

SEQ ID NO: 4078 - DNA, 52 bp, Homo sapiens
ctctctgtgtcagatttgaccttggaagatcacagaggaaaagcgagaagga

SEQ ID NO: 4079 - DNA, 130 bp, Homo sapiens
tgcctaaatgaagacgtatgggtcttttactgttttttgctgttacaaagaatgtcaccgtggctgcctgtatgcatgctatctttaccacagatgtctgaagtttcctccaggttgggcagtttaaaga

SEQ ID NO: 4080 - DNA, 107 bp, Homo sapiens
gctctgggtgatctggtttctgtctgcctctgccacctcttctggtgcagctctgctcgtcactgctgaagccacactgggatatggcttgttcttggacacccaga

What is claimed is:

1. A method for modifying RNA splicing in order to produce a mature mRNA transcript having an intronic exon (iExon), the method comprising contacting 5-(1H-pyrazol-4-yl)-2-(6-((2,2,6,6-tetramethylpiperidin-4-yl)oxy)pyridazin-3-yl)phenol having the formula

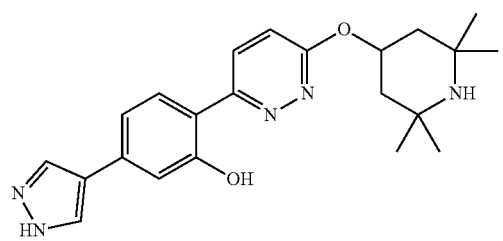

or a form thereof with a cell containing a pre-mRNA transcript in cell culture or with a cell lysate containing a pre-mRNA transcript, wherein the pre-mRNA transcript comprises two exons and an intron, wherein a first exon is upstream of the intron and a second exon is downstream of the intron, wherein the intron comprises in 5' to 3' order: a first 5' splice site, a first branch point, a first 3' splice site, an intronic recognition element for splicing modifier (iREMS), a second branch point, and a second 3' splice site, wherein the iREMS comprises an RNA sequence GAgurngn, wherein r is adenine or guanine and n is any nucleotide, and wherein the pre-mRNA transcript is a pre-mRNA transcript of a gene selected from the group consisting of:

(a) ADAL, ADAM23, ADAMTS19, AGPS, AKAP8L, ANKRD13C, ANXA11, ARL15, ARSJ, BECN1, BIN3, BTBD10, C11orf30, C12orf4, C1orf27, C2orf47, CACNB1, CACNB4, CADM2, CDH18, CEP162, CEP170, CEP192, CHEK1, CHRM2, CMAHP, CNRIP1, CNTN1, CUX1, DAAM1, DCAF17, DCUN1D4, DDX42, DET1, DENND1A, DENND4A, DENND5A, DGKI, DHFR, DIAPH3, DLG5, DYRK1A, DZIP1L, ELMO2, ENAH, ENOX1, EVC, FAM162A, FAM174A, FAM208B, FAM69B, FBXL16, FGD4, FHOD3, GALC, GOLGB1, GTSF1, GXYLT1, HDAC5, HDX, HTT, IFT57, INO80, INVS, KDM6A, KIDINS220, KIF21A, L3MBTL2, LINCR-0002, LINGO2, LOC400927, LPHN1, LRRC1, LRRC42, LYRM1, MACROD2, MAPK10, MARCH8, MDN1, MEAF6, MEMO1, MFN2, MLLT10, MRPL39, MRPL45, MRPS28, MTMR3, MYB, MYCBP2, NSUN4, NUPL1, OSBPL3, PAPD4, PCDH10, PDE3A, PDE7A, PDXDC1, PDXDC2P, PELI1, PITPNB, PMS1, POMT2, PSMA4, RAB23, RAF1, RCOR3, RERE, RNF130, RNF144A, RNF213, RPF2, RPS10, SCO1, SENP6, SF3B3, SGMS1, SGPL1, SLC25A16, SLC25A17, SNX24, SNX7, SORCS1, SPIDR, SPRYD7, SREK1, SSBP1, STRADB, SUPT20H, TAF2, TARBP1, TASP1, TBCA, TCF4, TET1, TIAM1, TJP2, TMEM214, TNRC6A, TRAF3, TRIM65, TSPAN7, UBN2, URGCP-MRPS24, UVRAG, WDR27, WDR90, WNK1, XRN2, ZFP82, ZMIZ2, ZNF138, ZNF208, ZNF212, ZNF280D, ZNF37BP, ZNF426, ZNF618, ZNF680, ZNF730, ZNF836, and ZSCAN25;

(b) ADAL, ADAM23, ADAMTS19, AGPS, AKAP8L, ANKRD13C, ANXA11, ARL15, ARSJ, BECN1, BIN3, BTBD10, C11orf30, C12orf4, C1orf27, C2orf47, CACNB1, CACNB4, CADM2, CDH18, CENPI, CEP162, CEP170, CEP192, CHEK1, CHRM2, CMAHP, CNRIP1, CNTN1, CRYBG3, CUX1, DAAM1, DCAF17, DCUN1D4, DDX42, DENND1A, DENND4A, DENND5A, DET1, DGKI, DHFR, DIAPH3, DLG5, DYRK1A, DZIP1L, ELMO2, ENAH, ENOX1, ERC2, EVC, FAM162A, FAM174A, FAM195B, FAM208B, FAM69B, FBXL16, FGD4, FHOD3, GALC, GLCE, GOLGB1, GXYLT1, HDAC5, HDX, HTT, IFT57, INO80, INVS, KDM6A, KIDINS220, KIF21A, L3MBTL2, LINCR-0002, LINGO2, LOC400927, LPHN1, LRRC1, LRRC42, LYRM1, MACROD2, MAPK10, 44628, MDN1, MEAF6, MEMO1, MFN2, MLLT10, MRPL39, MRPL45, MRPS28, MTMR3, MYB, MYCBP2, MYLK, NLGN1, NSUN4, NUPL1, OSBPL3, PAPD4, PCDH10, PDE3A, PDE7A, PDXDC1, PDXDC2P, PELI1, PITPNB, PMS1, POMT2, PSMA4, RAB23, RAF1, RASIP1, RCOR3, RERE, RNF130, RNF144A, RNF213, RPF2, RPS10, SCO1, SENP6, SF3B3, SGMS1, SGPL1, SLC25A16, SLC25A17, SNX24, SNX7, SORCS1, SPIDR, SPRYD7, SREK1, SSBP1, STRADB, STXBP4, SUPT20H, TAF2, TARBP1, TASP1, TBCA, TCF4, TEKT4P2, TET1, TIAM1, TJP2, TMEM214, TNRC6A, TRAF3, TRIM65, TSPAN7, UBN2, URGCP-MRPS24, UVRAG, WDR27, WDR90, WNK1, XRN2, ZFP82, ZMIZ2, ZNF138, ZNF208, ZNF212, ZNF280D, ZNF37BP, ZNF426, ZNF618, ZNF680, ZNF730, ZNF836, and ZSCAN25, or (c) ABHD10, ADAM17, AGPAT4, AGPS, AKT1, ANKRD13C, ANXA11, APIP, APPL2, ARHGAP1, ARHGAP5, ARL15, ARL5B, ASAP1, ATF6, BECN1, BHMT2, BIN3, BNC2, BTBD10, C10orf76, C11orf30, C11orf73, C12orf4, C1orf27, C1QTNF9B-AS1, CCNL2, CDH18, CENPI, CEP57, CMSS1, CNOT7, COPS7B, CRISPLD2, CUX1, DCAF17, DDX42, DENND4A, DENND5A, DET1, DLG5, DMXL1, DNAJA4, DNMBP, ENAH, EP300, ERC1, EVC, EXOC3, EXOC6B, FAM162A, FAM174A, FAM208B, FAM49B, FBN2, GBP1, GNG12, GXYLT1, HDX, HMGXB4, HOXB3, HSD17B4, IFT57, IKBKAP, INO80, INPP4B, ITCH, IVD, KDM6A, KDSR, KIAA1524, KIAA1715, KIDINS220, L3MBTL2, LGALS3, LOC400927, LRRC42, LYRM1, MACROD2, MANEA, MARCH7, MARCH8, MEAF6, MEMO1, MFN2, MMS19, MORF4L1, MRPL39, MRPL45, MRPS28, MYCBP2, MYLK, MZT1, NEDD4, NFASC, NGF, NIPA1, NLN, NREP, NUPL1, OSBPL3, PAPD4, PBX3, PDE7A, PIGN, PITPNB, PNISR, POMT2, PPARG, PPFIBP1, PRPF31, PSMA4, PXK, RAB23, RAF1, RAPGEF1, RBBP8, RERE, RGL1, RPF2, SAMD4A, SCO1, SENP6, SF3B3, SGIP1, SH2B3, SKP1, SLC12A2, SLC25A17, SMOX, SNAP23, SNX24, SNX7, SOCS6, SOGA2, SPIDR, SSBP1, STRADB, STXBP6, SUPT20H, TAF2, TASP1, TBCA, TBL1XR1, TCF4, TJAP1, TJP2, TMEM214, TMX3, TNRC6A, TXNL4B, UBE2D3, UBE2L3, UNC13B, URGCP-MRPS24, VDAC2, WHSC2, WNK1, XRN2, ZFP82, ZNF138, ZNF350, ZNF37BP, ZNF618, ZNF680, ZNF777, ZNF804A, and ZSCAN25.

2. A method for modifying RNA splicing in order to modulate the amount of a mature mRNA transcript produced from a pre-mRNA transcript, the method comprising contacting 5-(1H-pyrazol-4-yl)-2-(6-((2,2,6,6-tetramethylpiperidin-4-yl)oxy)pyridazin-3-yl)phenol having the formula

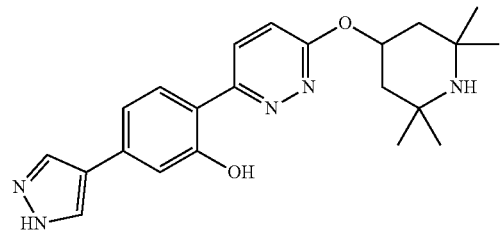

or a form thereof with a cell containing a pre-mRNA transcript in cell culture or with a cell lysate containing a pre-mRNA transcript, wherein the pre-mRNA transcript comprises two exons and an intron, wherein a first exon is upstream of the intron and a second exon is downstream of the intron, wherein the intron comprises in 5' to 3' order: an intronic recognition element for splicing modifier (iREMS), a branch point, and a 3' splice site, wherein the iREMS comprises an RNA sequence GAgurngn, wherein r is adenine or guanine and n is any nucleotide, and wherein the pre-mRNA transcript is a pre-mRNA transcript of a gene selected from the group consisting of:

(a) ADAL, ADAM23, ADAMTS19, AGPS, AKAP8L, ANKRD13C, ANXA11, ARL15, ARSJ, BECN1, BIN3, BTBD10, C11orf30, C12orf4, C1orf27, C2orf47, CACNB1, CACNB4, CADM2, CDH18, CEP162, CEP170, CEP192, CHEK1, CHRM2, CMAHP, CNRIP1, CNTN1, CUX1, DAAM1, DCAF17, DCUN1D4, DDX42, DET1, DENND1A, DENND4A, DENND5A, DGKI, DHFR, DIAPH3, DLG5, DYRK1A, DZIP1L, ELMO2, ENAH, ENOX1, EVC, FAM162A, FAM174A, FAM208B, FAM69B, FBXL16, FGD4, FHOD3, GALC, GOLGB1, GTSF1, GXYLT1, HDAC5, HDX, HTT, IFT57, INO80, INVS, KDM6A, KIDINS220, KIF21A, L3MBTL2, LINCR-0002, LINGO2, LOC400927, LPHN1, LRRC1, LRRC42, LYRM1, MACROD2, MAPK10, MARCH8, MDN1, MEAF6, MEMO1, MFN2, MLLT10, MRPL39, MRPL45, MRPS28, MTMR3, MYB, MYCBP2, NSUN4, NUPL1, OSBPL3, PAPD4, PCDH10, PDE3A, PDE7A, PDXDC1, PDXDC2P, PELI1, PITPNB, PMS1, POMT2, PSMA4, RAB23, RAF1, RCOR3, RERE, RNF130, RNF144A, RNF213, RPF2, RPS10, SCO1, SENP6, SF3B3, SGMS1, SGPL1, SLC25A16, SLC25A17, SNX24, SNX7, SORCS1, SPIDR, SPRYD7, SREK1, SSBP1, STRADB, SUPT20H, TAF2, TARBP1, TASP1, TBCA, TCF4, TET1, TIAM1, TJP2, TMEM214, TNRC6A, TRAF3, TRIM65, TSPAN7, UBN2, URGCP-MRPS24, UVRAG, WDR27, WDR90, WNK1, XRN2, ZFP82, ZMIZ2, ZNF138, ZNF208, ZNF212, ZNF280D, ZNF37BP, ZNF426, ZNF618, ZNF680, ZNF730, ZNF836, and ZSCAN25, (b) ADAL, ADAM23, ADAMTS19, AGPS, AKAP8L, ANKRD13C, ANXA11, ARL15, ARSJ, BECN1, BIN3, BTBD10, C11orf30, C12orf4, C1orf27, C2orf47, CACNB1, CACNB4, CADM2, CDH18, CENPI, CEP162, CEP170, CEP192, CHEK1, CHRM2, CMAHP, CNRIP1, CNTN1, CRYBG3, CUX1, DAAM1, DCAF17, DCUN1D4, DDX42, DENND1A, DENND4A, DENND5A, DET1, DGKI, DHFR, DIAPH3, DLG5, DYRK1A, DZIP1L, ELMO2, ENAH, ENOX1, ERC2, EVC, FAM162A, FAM174A, FAM195B, FAM208B, FAM69B, FBXL16, FGD4, FHOD3, GALC, GLCE, GOLGB1, GXYLT1, HDAC5, HDX, HTT, IFT57, INO80, INVS, KDM6A, KIDINS220, KIF21A, L3MBTL2, LINCR-0002, LINGO2, LOC400927, LPHN1, LRRC1, LRRC42, LYRM1, MACROD2, MAPK10, 44628, MDN1, MEAF6, MEMO1, MFN2, MLLT10, MRPL39, MRPL45, MRPS28, MTMR3, MYB, MYCBP2, MYLK, NLGN1, NSUN4, NUPL1, OSBPL3, PAPD4, PCDH10, PDE3A, PDE7A, PDXDC1, PDXDC2P, PELI1, PITPNB, PMS1, POMT2, PSMA4, RAB23, RAF1, RASIP1, RCOR3, RERE, RNF130 RNF144A RNF213, RPF2, RPS10, SCO1, SENP6, SF3B3, SGMS1, SGPL1, SLC25A16, SLC25A17, SNX24, SNX7, SORCS1, SPIDR, SPRYD7, SREK1, SSBP1, STXBP4, SUPT20H, TAF2, TARBP1, TASP1, TBCA, TCF4, TEKT4P2, TET1, TIAM1, TJP2, TMEM214, TNRC6A, TRAF3, TRIM65, TSPAN7, UBN2, URGCP-MRPS24, UVRAG, WDR27, WDR90, WNK1, XRN2, ZFP82, ZMIZ2, ZNF138, ZNF208, ZNF212, ZNF280D, ZNF37BP, ZNF426, ZNF618, ZNF680, ZNF730, ZNF836, and ZSCAN25; or (c) ABHD10, ADAM17, AGPAT4, AGPS, AKT1, ANKRD13C, ANXA11, APIP, APPL2, ARHGAP1, ARHGAP5, ARL15, ARL5B, ASAP1, ATF6, BECN1, BHMT2, BIN3, BNC2, BTBD10, C10orf76, C11orf30, C11orf73, C12orf4, C1orf27, C1QTNF9B-AS1, CCNL2, CDH18, CENPI, CEP57, CMSS1, CNOT7, COPS7B, CRISPLD2, CUX1, DCAF17, DDX42, DENND4A, DENND5A, DET1, DLG5, DMXL1, DNAJA4, DNMBP, ENAH, EP300, ERC1, EVC, EXOC3, EXOC6B, FAM162A, FAM174A, FAM208B, FAM49B, FBN2, GBP1, GNG12, GXYLT1, HDX, HMGXB4, HOXB3, HSD17B4, IFT57, IKBKAP, INO80, INPP4B, ITCH, IVD, KDM6A, KDSR, KIAA1524, KIAA1715, KIDINS220, L3MBTL2, LGALS3, LOC400927, LRRC42, LYRM1, MACROD2, MANEA, MARCH7, MARCH8, MEAF6, MEMO1, MFN2, MMS19, MORF4L1, MRPL39, MRPL45, MRPS28, MYCBP2, MYLK, MZT1, NEDD4, NFASC, NGF, NIPA1, NLN, NREP, NUPL1, OSBPL3, PAPD4, PBX3, PDE7A, PIGN, PITPNB, PNISR, POMT2, PPARG, PPFIBP1, PRPF31, PSMA4, PXK, RAB23, RAF1, RAPGEF1, RBBP8, RERE, RGL1, RPF2, SAMD4A, SCO1, SENP6, SF3B3, SGIP1, SH2B3, SKP1, SLC12A2, SLC25A17, SMOX, SNAP23, SNX24, SNX7, SOCS6, SOGA2, SPIDR, SSBP1, STRADB, STXBP6, SUPT20H, TAF2, TASP1, TBCA, TBL1XR1, TCF4, TJAP1, TJP2, TMEM214, TMX3, TNRC6A, TXNL4B, UBE2D3, UBE2L3, UNC13B, URGCP-MRPS24, VDAC2, WHSC2, WNK1, XRN2, ZFP82, ZNF138, ZNF350, ZNF37BP, ZNF618, ZNF680, ZNF777, ZNF804A, and ZSCAN25.

3. The method of claim 1, wherein the iREMS comprises an RNA sequence GAguragu, and wherein r is adenine or guanine.

4. The method of claim 1, wherein the iREMS comprises an RNA sequence NNGAgurngn (SEQ ID NO: 1), wherein r is adenine or guanine and n or N is any nucleotide, and wherein the RNA sequence NNGAgurngn (SEQ ID NO: 1) is selected from the group consisting of ANGAgurngn (SEQ ID NO: 4), CNGAgurngn (SEQ ID NO: 5), GNGAgurngn (SEQ ID NO: 6), UNGAgurngn (SEQ ID NO: 7), NAGAgurngn (SEQ ID NO: 8), NCGAgurngn (SEQ ID NO: 9), NGGAgurngn (SEQ ID NO: 10), NUGAgurngn (SEQ ID NO: 11), AAGAgurngn (SEQ ID NO: 12), ACGAgurngn (SEQ ID NO: 13), AGGAgurngn (SEQ ID NO: 14), AUGAgurngn (SEQ ID NO: 15), CAGAgurngn (SEQ ID NO: 16), CCGAgurngn (SEQ ID NO: 17), CGGAgurngn (SEQ ID NO: 18), CUGAgurngn (SEQ ID NO: 19), GAGAgurngn (SEQ ID NO: 20), GCGAgurngn (SEQ ID NO: 21), GGGAgurngn (SEQ ID NO: 22), GUGAgurngn (SEQ ID NO: 23), UAGAgurngn (SEQ ID NO: 24), UCGAgurngn (SEQ ID NO: 25), UGGAgurngn (SEQ ID NO: 52), and UUGAgurngn (SEQ ID NO: 53), wherein r is adenine or guanine and n or N is any nucleotide.

5. The method of claim 1, wherein the iREMS comprises an RNA sequence NNGAguragu (SEQ ID NO: 2), wherein r is adenine or guanine and N is any nucleotide, and wherein the RNA sequence NNGAguragu (SEQ ID NO: 2) is selected from the group consisting of ANGAguragu (SEQ ID NO: 28), CNGAguragu (SEQ ID NO: 29), GNGAguragu (SEQ ID NO: 30), UNGAguragu (SEQ ID NO: 31), NAGAguragu (SEQ ID NO: 32), NCGAguragu (SEQ ID NO: 33), NGGAguragu (SEQ ID NO: 34), NUGAguragu (SEQ ID NO: 35), AAGAguragu (SEQ ID NO: 36), ACGAguragu (SEQ ID NO: 37), AGGAguragu (SEQ ID NO: 38), AUGAguragu (SEQ ID NO: 39), CAGAguragu (SEQ ID NO: 40), CCGAguragu (SEQ ID NO: 41), CGGAguragu (SEQ ID NO: 42), CUGAguragu (SEQ ID NO: 43), GAGAguragu (SEQ ID NO: 44), GCGAguragu (SEQ ID NO: 45), GGGAguragu (SEQ ID NO: 46), GUGAguragu (SEQ ID NO: 47), UAGAguragu (SEQ ID NO: 48), UCGAguragu (SEQ ID NO: 49), UGGAguragu (SEQ ID NO: 489) and UUGAguragu (SEQ ID NO: 508), wherein r is adenine or guanine, and N is any nucleotide.

6. The method of claim 2, wherein the iREMS comprises an RNA sequence GAguragu, and wherein r is adenine or guanine.

7. The method of claim 2, wherein the iREMS comprises an RNA sequence NNGAgurngn (SEQ ID NO: 1), wherein r is adenine or guanine and n or N is any nucleotide, and wherein the RNA sequence NNGAgurngn (SEQ ID NO: 1) is selected from the group consisting of ANGAgurngn (SEQ ID NO: 4), CNGAgurngn (SEQ ID NO: 5), GNGAgurngn (SEQ ID NO: 6), UNGAgurngn (SEQ ID NO: 7), NAGAgurngn (SEQ ID NO: 8), NCGAgurngn (SEQ ID NO: 9), NGGAgurngn (SEQ ID NO: 10), NUGAgurngn (SEQ ID NO: 11), AAGAgurngn (SEQ ID NO: 12), ACGAgurngn (SEQ ID NO: 13), AGGAgurngn (SEQ ID NO: 14), AUGAgurngn (SEQ ID NO: 15), CAGAgurngn (SEQ ID NO: 16), CCGAgurngn (SEQ ID NO: 17), CGGAgurngn (SEQ ID NO: 18), CUGAgurngn (SEQ ID NO: 19), GAGAgurngn (SEQ ID NO: 20), GCGAgurngn (SEQ ID NO: 21), GGGAgurngn (SEQ ID NO: 22), GUGAgurngn (SEQ ID NO: 23), UAGAgurngn (SEQ ID NO: 24), UCGAgurngn (SEQ ID NO: 25), UGGAgurngn (SEQ ID NO: 52), and UUGAgurngn (SEQ ID NO: 53), wherein r is adenine or guanine and n or N is any nucleotide.

8. The method of claim 2, wherein the iREMS comprises an RNA sequence NNGAguragu (SEQ ID NO: 2), wherein r is adenine or guanine and N is any nucleotide, and wherein the RNA sequence NNGAguragu (SEQ ID NO: 2) is selected from the group consisting of ANGAguragu (SEQ ID NO: 28), CNGAguragu (SEQ ID NO: 29), GNGAguragu (SEQ ID NO: 30), UNGAguragu (SEQ ID NO: 31), NAGAguragu (SEQ ID NO: 32), NCGAguragu (SEQ ID NO: 33), NGGAguragu (SEQ ID NO: 34), NUGAguragu (SEQ ID NO: 35), AAGAguragu (SEQ ID NO: 36), ACGAguragu (SEQ ID NO: 37), AGGAguragu (SEQ ID NO: 38), AUGAguragu (SEQ ID NO: 39), CAGAguragu (SEQ ID NO: 40), CCGAguragu (SEQ ID NO: 41), CGGAguragu (SEQ ID NO: 42), CUGAguragu (SEQ ID NO: 43), GAGAguragu (SEQ ID NO: 44), GCGAguragu (SEQ ID NO: 45), GGGAguragu (SEQ ID NO: 46), GUGAguragu (SEQ ID NO: 47), UAGAguragu (SEQ ID NO: 48), UCGAguragu (SEQ ID NO: 49), UGGAguragu (SEQ ID NO: 489) and UUGAguragu (SEQ ID NO: 508), wherein r is adenine or guanine, and N is any nucleotide.

9. The method of claim 1, wherein the pre-mRNA transcript is a pre-mRNA transcript of a gene selected from the group consisting of:
(a) C12orf4, CDH18, CHEK1, DHFR, HDX, LOC400927, LRRC42, MEAF6, MYCBP2, PAPD4, PDE7A, POMT2, TAF2, TRIM65, and WDR27;
(b) ADAMTS19, BECN1, CACNB4, CADM2, CHEK1, CHRM2, CMAHP, DENND4A, DHFR, EVC, GXYLT1, MEMO1, MYCBP2, NUPL1, PDXDC1, SENP6, SPIDR, TNRC6A, TRIM65, URGCP-MRPS24, WDR90, ZFP82, ZNF618, and ZNF680; or
(c) AGPS, AKT1, ANXA11, ARHGAP5, ARL15, ATF6, BIN3, C11orf30, C11orf73, CDH18, CENPI, DCAF17, DENND4A, EXOC6B, FAM162A, FAM174A, FAM208B, HOXB3, IFT57, IVD, KIAA1715, KIDINS220, MYCBP2, SLC25A17, SNX24, SNX7, SPIDR, STRADB, TASP1, TCF4, TMEM214, UBE2D3, XRN2, ZNF618, and ZNF777.

10. The method of claim 1, wherein the pre-mRNA transcript is a pre-mRNA transcript of a gene selected from the group consisting of:
(a) ARL15, PDXDC2P, and ZNF37BP;
(b) ERC2, FHOD3, HDX, HTT, KDM6A, LOC400927, LRRC42, MACROD2, MEAF6, PAPD4, PDE7A, TAF2, TET1, TIAM1, and WDR27; or
(c) BECN1, BHMT2, C1orf27, ENAH, KIAA1524, LOC400927, LRRC42, LYRM1, MFN2, MORF4L1, NGF, NUPL1, PAPD4, PDE7A, RERE, SF3B3, STXBP6, TAF2, URGCP-MRPS24, WNK1, ZNF350, and ZNF680.

11. The method of claim 1, wherein the pre-mRNA transcript is a pre-mRNA transcript of a gene selected from the group consisting of:
(a) ELMO2;
(b) ARL15, C12orf4, CDH18, ELMO2, PDXDC2P, POMT2, RASIP1, and ZNF37BP; or
(c) ARL15, ASAP1, C12orf4, EVC, GXYLT1, HDX, KDM6A, MACROD2, MEAF6, MEMO1, POMT2, SENP6, TBCA, TNRC6A, UBE2L3, VDAC2, ZFP82, ZNF138, and ZNF37BP.

12. The method of claim 1, wherein:
(a) the pre-mRNA transcript is a pre-mRNA transcript of the HTT gene;
(b) the pre-mRNA transcript is a pre-mRNA transcript of a gene selected from the group consisting of: ARL15, C12orf4, CDH18, CHEK1, DHFR, ELMO2, HDX, LOC400927, LRRC42, MEAF6, MYCBP2, PAPD4, PDE7A, PDXDC2P, POMT2, TAF2, TRIM65, WDR27, ZNF37BP, ADAMTS19, BECN1, CACNB4, CADM2, CHRM2, CMAHP, DENND4A, ERC2, EVC, FHOD3, GXYLT1, HTT, KDM6A, MACROD2, MEMO1, NUPL1, PDXDC1, RASIP1, SENP6, SPIDR, TET1, TIAM1, TNRC6A, URGCP-MRPS24, WDR90, ZFP82, ZNF618, ZNF680, AGPS, AKT1, ANXA11, ARHGAP5, ATF6, ASAP1, BHMT2, BIN3, C11orf30, C11orf73, C1orf27, CENPI, DCAF17, ENAH, EXOC6B, FAM162A, FAM174A, FAM208B, HOXB3, IFT57, IVD, KIAA1524, KIAA1715, KIDINS220, LYRM1, MFN2, MORF4L1, NGF, RERE, SF3B3, SLC25A17, SNX24, SNX7, STRADB, STXBP6, TA5P1, TBCA, TCF4, TMEM214, UBE2D3, UBE2L3, VDAC2, WNK1, XRN2, ZNF138, ZNF350, and ZNF777; or
(c) the pre-mRNA transcript is a pre-mRNA transcript of a gene selected from the group consisting of DIAPH3, NIPA1, RAF1, DCAF17 2a, GNG12, HMGXB4, MRPL45, NSUN4, PITPNB, DCAF17 6a, DMXL1, GALC, GBP1, SREK1, SSBP1, DENND5A, DGK1, GTSF1, L3MBTL2, MMS19, PMS1, PRPF31, SKP1, and SUPT20H.

13. The method of claim 2, wherein the intron further comprises in 5' to 3' order: a 5' splice site, a branch point, and a 3' splice site, wherein the 5' splice site, the branch point, and the 3' splice site are upstream of the iREMS.

14. The method of claim 2, wherein the pre-mRNA transcript is a pre-mRNA transcript of a gene selected from the group consisting of:
(a) C12orf4, CDH18, CHEK1, DHFR, HDX, LOC400927, LRRC42, MEAF6, MYCBP2, PAPD4, PDE7A, POMT2, TAF2, TRIM65, and WDR27;
(b) ADAMTS19, BECN1, CACNB4, CADM2, CHEK1, CHRM2, CMAHP, DENND4A, DHFR, EVC, GXYLT1, MEMO1, MYCBP2, NUPL1, PDXDC1, SENP6, SPIDR, TNRC6A, TRIM65, URGCP-MRPS24, WDR90, ZFP82, ZNF618, and ZNF680; or
(c) AGPS, AKT1, ANXA11, ARHGAP5, ARL15, ATF6, BIN3, C11orf30, C11orf73, CDH18, CENPI, DCAF17, DENND4A, EXOC6B, FAM162A, FAM174A, FAM208B, HOXB3, IFT57, IVD, KIAA1715, KIDINS220, MYCBP2, SLC25A17, SNX24, SNX7, SPIDR, STRADB, TASP1, TCF4, TMEM214, UBE2D3, XRN2, ZNF618, and ZNF777.

15. The method of claim 2, wherein the pre-mRNA transcript is a pre-mRNA transcript of a gene selected from the group consisting of:
(a) ARL15, PDXDC2P, and ZNF37BP;
(b) ERC2, FHOD3, HDX, HTT, KDM6A, LOC400927, LRRC42, MACROD2, MEAF6, PAPD4, PDE7A, TAF2, TET1, TIAM1, and WDR27; or
(c) BECN1, BHMT2, C1orf27, ENAH, KIAA1524, LOC400927, LRRC42, LYRM1, MFN2, MORF4L1, NGF, NUPL1, PAPD4, PDE7A, RERE, SF3B3, STXBP6, TAF2, URGCP-MRPS24, WNK1, ZNF350, and ZNF680.

16. The method of claim 2, wherein the pre-mRNA transcript is a pre-mRNA transcript of a gene selected from the group consisting of:
(a) ELMO2;
(b) ARL15, C12orf4, CDH18, ELMO2, PDXDC2P, POMT2, RASIP1, and ZNF37BP; or
(c) ARL15, ASAP1, C12orf4, EVC, GXYLT1, HDX, KDM6A, MACROD2, MEAF6, MEMO1, POMT2, SENP6, TBCA, TNRC6A, UBE2L3, VDAC2, ZFP82, ZNF138, and ZNF37BP.

17. The method of claim 2, wherein:
(a) the pre-mRNA transcript is a pre-mRNA transcript of the HTT gene;
(b) the pre-mRNA transcript is a pre-mRNA transcript of a gene selected from the group consisting of: ARL15, C12orf4, CDH18, CHEK1, DHFR, ELMO2, HDX, LOC400927, LRRC42, MEAF6, MYCBP2, PAPD4, PDE7A, PDXDC2P, POMT2, TAF2, TRIM65, WDR27, ZNF37BP, ADAMTS19, BECN1, CACNB4, CADM2, CHRM2, CMAHP, DENND4A, ERC2, EVC, FHOD3, GXYLT1, HTT, KDM6A, MACROD2, MEMO1, NUPL1, PDXDC1, RASIP1, SENP6, SPIDR, TET1, TIAM1, TNRC6A, URGCP-MRPS24, WDR90, ZFP82, ZNF618, ZNF680, AGPS, AKT1, ANXA11, ARHGAP5, ATF6, ASAP1, BHMT2, BIN3, C11orf30, C11orf73, C1orf27, CENPI, DCAF17, ENAH, EXOC6B, FAM162A, FAM174A, FAM208B, HOXB3, IFT57, IVD, KIAA1524, KIAA1715, KIDINS220, LYRM1, MFN2, MORF4L1, NGF, RERE, SF3B3, SLC25A17, SNX24, SNX7, STRADB, STXBP6, TASP1, TBCA, TCF4, TMEM214, UBE2D3, UBE2L3, VDAC2, WNK1, XRN2, ZNF138, ZNF350, and ZNF777; or
(c) the pre-mRNA transcript is a pre-mRNA transcript of a gene selected from the group consisting of DIAPH3, NIPA1, RAF1, DCAF17 2a, GNG12, HMGXB4, MRPL45, NSUN4, PITPNB, DCAF17 6a, DMXL1, GALC, GBP1, SREK1, SSBP1, DENND5A, DGK1, GTSF1, L3MBTL2, MMS19, PMS1, PRPF31, SKP1, and SUPT20H.

\* \* \* \* \*

UNITED STATES PATENT AND TRADEMARK OFFICE
CERTIFICATE OF CORRECTION

PATENT NO. : 11,608,501 B2
APPLICATION NO. : 16/622223
DATED : March 21, 2023
INVENTOR(S) : Anuradha Bhattacharyya et al.

It is certified that error appears in the above-identified patent and that said Letters Patent is hereby corrected as shown below:

In the Claims

In Column 488, Claim 1, Line 13, please replace "," after term "ZSCAN25" to read: --ZSCAN25;--

In Column 489, Claim 2, Line 40, please replace "," after term "ZSCAN25" to read: --ZSCAN25;--

In Column 489, Claim 2, Line 62, please add "," after terms "RNF130" and "RNF144A"

Signed and Sealed this
Sixteenth Day of May, 2023

Katherine Kelly Vidal
*Director of the United States Patent and Trademark Office*